US008822653B2

(12) United States Patent
Sexton et al.

(10) Patent No.: US 8,822,653 B2
(45) Date of Patent: Sep. 2, 2014

(54) PLASMA KALLIKREIN BINDING PROTEINS

(75) Inventors: Daniel J. Sexton, Melrose, MA (US); Malini Viswanathan, Burlington, MA (US)

(73) Assignee: Dyax Corp., Burlington, MA (US)

( * ) Notice: Subject to any disclaimer, the term of this patent is extended or adjusted under 35 U.S.C. 154(b) by 414 days.

(21) Appl. No.: 12/985,914

(22) Filed: Jan. 6, 2011

(65) Prior Publication Data

US 2011/0200611 A1 Aug. 18, 2011

Related U.S. Application Data

(60) Provisional application No. 61/292,614, filed on Jan. 6, 2010.

(51) Int. Cl.
*A61K 39/395* (2006.01)
*C07K 16/40* (2006.01)

(52) U.S. Cl.
USPC .............. 530/389.3; 530/387.1; 424/158.1

(58) Field of Classification Search
CPC .......... A61K 2300/00; A61K 38/4846; A61K 31/737; A61K 38/36; A61K 31/727
See application file for complete search history.

(56) References Cited

U.S. PATENT DOCUMENTS

| | | | |
|---|---|---|---|
| 3,682,776 A | 8/1972 | Grundmann et al. |
| 3,691,016 A | 9/1972 | Patel |
| 3,969,287 A | 7/1976 | Jaworek et al. |
| 4,118,481 A | 10/1978 | Schnabel et al. |
| 4,153,687 A | 5/1979 | Schnabel et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,330,440 A | 5/1982 | Ayers et al. |
| 4,377,572 A | 3/1983 | Schwarz et al. |
| 4,399,216 A | 8/1983 | Axel et al. |
| 4,595,674 A | 6/1986 | Tschesche et al. |
| 4,609,725 A | 9/1986 | Brady et al. |
| 4,634,665 A | 1/1987 | Axel et al. |
| 4,657,893 A | 4/1987 | Krantz et al. |
| 4,845,242 A | 7/1989 | Powers et al. |
| 4,881,175 A | 11/1989 | Ladner |
| 4,946,778 A | 8/1990 | Ladner et al. |
| 4,966,852 A | 10/1990 | Wun et al. |
| 5,106,833 A | 4/1992 | Broze, Jr. et al. |
| 5,118,668 A | 6/1992 | Auerswald et al. |
| 5,166,133 A | 11/1992 | Houston et al. |
| 5,179,017 A | 1/1993 | Axel et al. |
| 5,212,091 A | 5/1993 | Diaz-Collier et al. |
| 5,223,409 A | 6/1993 | Ladner et al. |
| 5,260,203 A | 11/1993 | Ladner et al. |
| 5,278,144 A | 1/1994 | Wolf |
| 5,278,285 A | 1/1994 | Ebbers et al. |
| 5,312,736 A | 5/1994 | Rasmussen et al. |
| 5,372,933 A | 12/1994 | Zamarron et al. |
| 5,373,090 A | 12/1994 | Norris et al. |
| 5,378,614 A | 1/1995 | Petersen et al. |
| 5,407,915 A | 4/1995 | Fritz et al. |
| 5,409,895 A | 4/1995 | Morishita et al. |
| 5,426,224 A | 6/1995 | Lee et al. |
| 5,441,931 A | 8/1995 | Sprecher et al. |
| 5,444,156 A | 8/1995 | Veloso et al. |
| 5,446,090 A | 8/1995 | Harris |
| 5,455,338 A | 10/1995 | Sprecher et al. |
| 5,466,783 A | 11/1995 | Wun et al. |
| 5,563,123 A | 10/1996 | Innis et al. |
| 5,576,294 A | 11/1996 | Norris et al. |
| 5,583,107 A | 12/1996 | Wolf et al. |
| 5,585,089 A | 12/1996 | Queen et al. |
| 5,589,359 A | 12/1996 | Innis et al. |
| 5,618,696 A | 4/1997 | Norris et al. |
| 5,629,176 A | 5/1997 | Børn et al. |
| 5,635,187 A | 6/1997 | Bathurst et al. |
| 5,648,331 A | 7/1997 | Koudsi et al. |
| 5,663,143 A | 9/1997 | Ley et al. |
| 5,672,662 A | 9/1997 | Harris et al. |
| 5,677,146 A | 10/1997 | Sprecher et al. |
| 5,693,761 A | 12/1997 | Queen et al. |
| 5,693,762 A | 12/1997 | Queen et al. |
| 5,695,760 A | 12/1997 | Faanes et al. |
| 5,696,088 A | 12/1997 | Innis et al. |
| 5,719,041 A | 2/1998 | Lazarus et al. |
| 5,736,364 A | 4/1998 | Kelley et al. |
| 5,739,208 A | 4/1998 | Harris |
| 5,747,449 A | 5/1998 | Lasters et al. |
| 5,770,568 A | 6/1998 | Auerswald et al. |
| 5,780,265 A | 7/1998 | Dennis et al. |

(Continued)

FOREIGN PATENT DOCUMENTS

| | | |
|---|---|---|
| AT | 275583 T | 9/2004 |
| CA | 2180950 A1 | 8/1995 |

(Continued)

OTHER PUBLICATIONS

U.S. Appl. No. 10/016,329, filed Oct. 26, 2001, Markland, William, Abandoned.
U.S. Appl. No. 10/931,153, filed Aug. 30, 2004, Ley, Arthur C., Abandoned.
U.S. Appl. No. 11/322,960, filed Dec. 30, 2005, Ladner, Robert C., Abandoned.
U.S. Appl. No. 11/646,148, filed Dec. 27, 2006, Ladner, Robert C., Published.
U.S. Appl. No. 11/716,278, filed Mar. 9, 2007, Clark, Eliana, Published.
U.S. Appl. No. 11/796,272, filed Apr. 27, 2007, Ladner, Robert C., Abandoned.
U.S. Appl. No. 11/860,853, filed Sep. 25, 2007, Ladner, Robert C., Abandoned.
U.S. Appl. No. 11/930,018, filed Oct. 30, 2007, Ladner, Robert C., Abandoned.
U.S. Appl. No. 11/929,876, filed Oct. 30, 2007, Ladner, Robert C., Abandoned.

(Continued)

*Primary Examiner* — Sharon Wen
(74) *Attorney, Agent, or Firm* — Wolf, Greenfield & Sacks, P.C.

(57) ABSTRACT

Plasma kallikrein binding proteins and methods of using such proteins are described.

32 Claims, 18 Drawing Sheets

(56) References Cited

U.S. PATENT DOCUMENTS

| | | |
|---|---|---|
| 5,786,328 A | 7/1998 | Dennis et al. |
| 5,795,865 A | 8/1998 | Markland et al. |
| 5,795,954 A | 8/1998 | Lazarus et al. |
| 5,800,385 A | 9/1998 | Demopulos et al. |
| 5,804,376 A | 9/1998 | Braxton et al. |
| 5,834,244 A | 11/1998 | Dennis et al. |
| 5,843,895 A | 12/1998 | Lazarus et al. |
| 5,849,992 A | 12/1998 | Meade et al. |
| 5,853,723 A | 12/1998 | Jacobs et al. |
| 5,863,893 A | 1/1999 | Dennis et al. |
| 5,869,637 A | 2/1999 | Au-Young et al. |
| 5,874,407 A | 2/1999 | Kelley et al. |
| 5,880,256 A | 3/1999 | Dennis et al. |
| 5,900,461 A | 5/1999 | Harris |
| 5,914,316 A | 6/1999 | Brown et al. |
| 5,932,462 A | 8/1999 | Harris et al. |
| 5,951,974 A | 9/1999 | Gilbert et al. |
| 5,962,266 A | 10/1999 | White et al. |
| 5,990,237 A | 11/1999 | Bentley et al. |
| 5,994,125 A | 11/1999 | Markland et al. |
| 6,001,596 A | 12/1999 | Hillman et al. |
| 6,004,579 A | 12/1999 | Bathurst et al. |
| 6,008,196 A | 12/1999 | Curran et al. |
| 6,010,880 A | 1/2000 | Markland et al. |
| 6,013,448 A | 1/2000 | Braxton et al. |
| 6,013,763 A | 1/2000 | Braisted et al. |
| 6,017,723 A | 1/2000 | Rao et al. |
| 6,057,287 A | 5/2000 | Markland et al. |
| 6,063,764 A | 5/2000 | Creasey et al. |
| 6,071,723 A | 6/2000 | Markland et al. |
| 6,087,473 A | 7/2000 | Conklin et al. |
| 6,090,916 A | 7/2000 | Vlasuk et al. |
| 6,103,499 A | 8/2000 | Markland et al. |
| 6,103,500 A | 8/2000 | Innis et al. |
| 6,113,896 A | 9/2000 | Lazarus et al. |
| 6,126,933 A | 10/2000 | Warne et al. |
| 6,159,938 A | 12/2000 | Gyorkos et al. |
| 6,171,587 B1 | 1/2001 | Wun et al. |
| 6,174,721 B1 | 1/2001 | Innis et al. |
| 6,180,607 B1 | 1/2001 | Davies et al. |
| 6,214,966 B1 | 4/2001 | Harris |
| 6,242,414 B1 | 6/2001 | Johnson et al. |
| 6,258,351 B1 | 7/2001 | Harris |
| 6,261,279 B1 | 7/2001 | Demopulos et al. |
| 6,306,884 B1 | 10/2001 | Buckman et al. |
| 6,333,402 B1 | 12/2001 | Markland et al. |
| 6,348,558 B1 | 2/2002 | Harris et al. |
| 6,362,254 B2 | 3/2002 | Harris et al. |
| 6,362,276 B1 | 3/2002 | Harris et al. |
| 6,376,604 B2 | 4/2002 | Kozlowski |
| 6,407,213 B1 | 6/2002 | Carter et al. |
| 6,413,507 B1 | 7/2002 | Bentley et al. |
| 6,423,498 B1 | 7/2002 | Markland et al. |
| 6,432,397 B1 | 8/2002 | Harris |
| 6,455,639 B1 | 9/2002 | Yasukohchi et al. |
| 6,472,195 B2 | 10/2002 | Hillman et al. |
| 6,515,100 B2 | 2/2003 | Harris |
| 6,534,276 B1 | 3/2003 | Wun et al. |
| 6,548,262 B2 | 4/2003 | Gentz et al. |
| 6,576,235 B1 | 6/2003 | Williams et al. |
| 6,583,108 B1 | 6/2003 | Tamburini et al. |
| 6,610,281 B2 | 8/2003 | Harris |
| 6,624,246 B2 | 9/2003 | Kozlowski |
| 6,664,331 B2 | 12/2003 | Harris et al. |
| 6,689,582 B1 | 2/2004 | Davies et al. |
| 6,710,125 B2 | 3/2004 | Kozlowski |
| 6,774,180 B2 | 8/2004 | Kozlowski et al. |
| 6,783,960 B2 | 8/2004 | Innis et al. |
| 6,783,965 B1 | 8/2004 | Sherman et al. |
| 6,806,360 B2 | 10/2004 | Wun et al. |
| 6,814,982 B2 | 11/2004 | Poncin et al. |
| 6,914,135 B2 | 7/2005 | Sheppard et al. |
| 6,953,674 B2 | 10/2005 | Markland et al. |
| 6,989,369 B2 | 1/2006 | Ladner et al. |
| 7,064,107 B2 | 6/2006 | Ladner et al. |
| 7,067,144 B2 | 6/2006 | Demopulos et al. |
| 7,078,383 B2 | 7/2006 | Ley et al. |
| 7,153,829 B2 | 12/2006 | Ladner et al. |
| 7,166,576 B2 | 1/2007 | Cicardi et al. |
| 7,235,530 B2 | 6/2007 | Blair et al. |
| 7,276,480 B1 | 10/2007 | Ladner et al. |
| 7,550,427 B2 | 6/2009 | Ley et al. |
| 7,628,983 B2 | 12/2009 | Markland et al. |
| 7,704,949 B2 | 4/2010 | Ladner et al. |
| 7,718,617 B2 | 5/2010 | Cicardi et al. |
| 7,811,991 B2 | 10/2010 | Ladner et al. |
| 7,851,442 B2 | 12/2010 | Ladner et al. |
| 7,919,462 B2 | 4/2011 | Markland et al. |
| 8,034,775 B2 | 10/2011 | Ladner et al. |
| 8,124,586 B2 | 2/2012 | Ladner et al. |
| 8,188,045 B2 | 5/2012 | Blair et al. |
| 8,283,321 B2 | 10/2012 | Markland et al. |
| 2001/0027180 A1 | 10/2001 | Isaacs |
| 2002/0102703 A1 | 8/2002 | Sheppard et al. |
| 2002/0111460 A1 | 8/2002 | Holloway |
| 2003/0012969 A1 | 1/2003 | Clark |
| 2003/0096733 A1 | 5/2003 | Ny et al. |
| 2003/0100070 A1 | 5/2003 | Holloway |
| 2003/0113726 A1 | 6/2003 | Tsuchihashi et al. |
| 2003/0114372 A1 | 6/2003 | White et al. |
| 2003/0153046 A1 | 8/2003 | Jensen et al. |
| 2003/0175919 A1 | 9/2003 | Ley et al. |
| 2003/0223977 A1 | 12/2003 | Ley et al. |
| 2004/0038893 A1 | 2/2004 | Ladner et al. |
| 2004/0049018 A1 | 3/2004 | Bailon et al. |
| 2004/0053206 A1 | 3/2004 | Cicardi et al. |
| 2004/0062746 A1 | 4/2004 | Martinez et al. |
| 2004/0062748 A1 | 4/2004 | Martinez et al. |
| 2004/0106747 A1 | 6/2004 | Bailon et al. |
| 2004/0126361 A1 | 7/2004 | Saifer et al. |
| 2004/0152633 A1 | 8/2004 | Jorgensen et al. |
| 2004/0171794 A1 | 9/2004 | Ladner et al. |
| 2004/0180827 A1 | 9/2004 | Chen et al. |
| 2004/0209243 A1 | 10/2004 | Nixon et al. |
| 2005/0004021 A1 | 1/2005 | Sprecher et al. |
| 2005/0075665 A1 | 4/2005 | Brenzel et al. |
| 2005/0089515 A1 | 4/2005 | Ley et al. |
| 2005/0164928 A1 | 7/2005 | Ladner et al. |
| 2005/0164945 A1 | 7/2005 | Nixon et al. |
| 2005/0180977 A1 | 8/2005 | Nixon et al. |
| 2006/0069020 A1 | 3/2006 | Blair et al. |
| 2006/0194727 A1 | 8/2006 | Ladner et al. |
| 2006/0228331 A1 | 10/2006 | Peschke et al. |
| 2006/0264603 A1 | 11/2006 | Markland et al. |
| 2007/0020252 A1 | 1/2007 | Ladner et al. |
| 2007/0041959 A1 | 2/2007 | Ley et al. |
| 2007/0049522 A1 | 3/2007 | Ladner et al. |
| 2007/0065407 A1 | 3/2007 | Patten et al. |
| 2007/0079096 A1 | 4/2007 | Chen |
| 2007/0100133 A1 | 5/2007 | Beals et al. |
| 2007/0117752 A1 | 5/2007 | Larsen et al. |
| 2007/0213275 A1 | 9/2007 | Clark et al. |
| 2007/0249807 A1 | 10/2007 | Ladner et al. |
| 2007/0253949 A1 | 11/2007 | Golz et al. |
| 2008/0038276 A1 | 2/2008 | Sinha et al. |
| 2008/0038748 A1* | 2/2008 | Kojima et al. ............ 435/7.1 |
| 2008/0050716 A1 | 2/2008 | Cicardi et al. |
| 2008/0064637 A1 | 3/2008 | Ladner et al. |
| 2008/0076712 A1 | 3/2008 | Ladner et al. |
| 2008/0131426 A1 | 6/2008 | Ladner et al. |
| 2008/0139473 A1 | 6/2008 | Ladner et al. |
| 2008/0152656 A1 | 6/2008 | Ladner et al. |
| 2008/0182283 A1 | 7/2008 | Markland et al. |
| 2008/0188409 A1 | 8/2008 | Blair et al. |
| 2008/0200646 A1 | 8/2008 | Ladner et al. |
| 2008/0221031 A1 | 9/2008 | Blair et al. |
| 2008/0226655 A1 | 9/2008 | Ladner et al. |
| 2008/0255025 A1 | 10/2008 | Ladner |
| 2008/0260752 A1 | 10/2008 | Ladner et al. |
| 2008/0299050 A1 | 12/2008 | Bortz et al. |
| 2009/0023651 A1 | 1/2009 | Markland et al. |
| 2009/0062195 A1 | 3/2009 | Ladner et al. |
| 2009/0075887 A1 | 3/2009 | McPherson |
| 2009/0082267 A1 | 3/2009 | Ladner et al. |

(56) References Cited

U.S. PATENT DOCUMENTS

| | | |
|---|---|---|
| 2009/0105142 A1 | 4/2009 | Moscicki |
| 2009/0117130 A1 | 5/2009 | Ladner et al. |
| 2009/0123475 A9 | 5/2009 | Siegel |
| 2009/0215119 A1 | 8/2009 | Ladner |
| 2009/0221480 A1 | 9/2009 | Blair et al. |
| 2009/0227494 A1 | 9/2009 | Blair et al. |
| 2009/0227495 A1 | 9/2009 | Blair et al. |
| 2009/0233852 A1 | 9/2009 | Blair et al. |
| 2009/0234009 A1 | 9/2009 | Blair et al. |
| 2009/0247452 A1 | 10/2009 | Ellis et al. |
| 2009/0247453 A1 | 10/2009 | Blair et al. |
| 2009/0264350 A1 | 10/2009 | Blair et al. |
| 2010/0034805 A1 | 2/2010 | Ladner et al. |
| 2010/0183625 A1* | 7/2010 | Sternlicht ............... 424/158.1 |
| 2010/0273721 A1 | 10/2010 | Belichard |
| 2010/0286061 A1 | 11/2010 | Devy et al. |
| 2011/0008762 A1 | 1/2011 | Cicardi et al. |
| 2011/0136746 A1 | 6/2011 | Markland et al. |
| 2011/0200611 A1 | 8/2011 | Sexton |
| 2012/0201756 A1 | 8/2012 | Sexton |
| 2012/0328517 A1 | 12/2012 | Markland et al. |
| 2013/0012438 A1 | 1/2013 | Blair et al. |

FOREIGN PATENT DOCUMENTS

| | | |
|---|---|---|
| DE | 69533472 T2 | 1/2006 |
| EP | 0132732 A2 | 2/1985 |
| EP | 0 210 029 A2 | 1/1987 |
| EP | 0255011 A2 | 2/1988 |
| EP | 0274826 A1 | 7/1988 |
| EP | 0285123 A2 | 10/1988 |
| EP | 301122 A1 | 2/1989 |
| EP | 0307592 A2 | 3/1989 |
| EP | 0318451 A2 | 5/1989 |
| EP | 0401508 A2 | 12/1990 |
| EP | 0486001 A1 | 5/1992 |
| EP | 0621870 B1 | 5/1997 |
| EP | 0621871 B1 | 7/1997 |
| EP | 739355 B1 | 9/2004 |
| EP | 1484339 A2 | 12/2004 |
| JP | 7-504891 T | 6/1995 |
| JP | 9-059838 A | 3/1997 |
| JP | 9-511131 T | 11/1997 |
| JP | 10503375 A | 3/1998 |
| JP | 2002-524076 A | 8/2002 |
| WO | 89/10374 A1 | 11/1989 |
| WO | 902809 A1 | 3/1990 |
| WO | 92/06111 A1 | 4/1992 |
| WO | 93/09233 A2 | 5/1993 |
| WO | 93/14120 A1 | 7/1993 |
| WO | 93/14121 A1 | 7/1993 |
| WO | 93/14122 A1 | 7/1993 |
| WO | 9314120 A1 | 7/1993 |
| WO | 9314121 A1 | 7/1993 |
| WO | 9314122 A1 | 7/1993 |
| WO | 95/18830 A2 | 7/1995 |
| WO | 95/21601 A2 | 8/1995 |
| WO | 9521601 A2 | 8/1995 |
| WO | 95/23860 A3 | 9/1995 |
| WO | 96/04378 A3 | 3/1996 |
| WO | 9620278 A2 | 7/1996 |
| WO | 96/35788 A2 | 11/1996 |
| WO | 9733996 A2 | 9/1997 |
| WO | 98/52976 A1 | 11/1998 |
| WO | 9963090 A2 | 12/1999 |
| WO | 00/14235 A1 | 3/2000 |
| WO | 00/34317 A2 | 6/2000 |
| WO | 0109968 A1 | 2/2001 |
| WO | 0114424 A1 | 3/2001 |
| WO | 0168707 A1 | 9/2001 |
| WO | 0179480 A1 | 10/2001 |
| WO | 0206334 A1 | 1/2002 |
| WO | 0206539 A1 | 1/2002 |
| WO | 02092147 A2 | 11/2002 |
| WO | 02094200 A2 | 11/2002 |
| WO | 03006860 A1 | 1/2003 |
| WO | 03066824 A2 | 8/2003 |
| WO | 03/103475 A2 | 12/2003 |
| WO | 2004/019968 A1 | 3/2004 |
| WO | 2004/062646 A1 | 7/2004 |
| WO | 2004/062689 A1 | 7/2004 |
| WO | 2005/021557 A2 | 3/2005 |
| WO | 2005021556 A2 | 3/2005 |
| WO | 2005021557 A2 | 3/2005 |
| WO | 2005/075665 A2 | 8/2005 |
| WO | 2006/017538 A2 | 2/2006 |
| WO | 2006036860 A2 | 4/2006 |
| WO | 2006/066878 A1 | 6/2006 |
| WO | 2006/089005 A2 | 8/2006 |
| WO | 2007079096 A2 | 7/2007 |
| WO | 2007106746 A2 | 9/2007 |
| WO | 2008000833 A1 | 1/2008 |
| WO | 2009/026334 A2 | 2/2009 |
| WO | 2009026539 A1 | 2/2009 |
| WO | 2009/102927 A1 | 8/2009 |
| WO | 2010003475 A2 | 1/2010 |
| WO | 2010006746 A2 | 1/2010 |
| WO | 2011/085103 A2 | 7/2011 |
| WO | 2012/094587 A1 | 7/2012 |

OTHER PUBLICATIONS

U.S. Appl. No. 11/929,685, filed Oct. 30, 2007, Ladner, Robert C., Abandoned.
U.S. Appl. No. 11/931,635, filed Oct. 31, 2007, Ladner, Robert C., Abandoned.
U.S. Appl. No. 11/931,695, filed Oct. 31, 2007, Ladner, Robert C., Abandoned.
U.S. Appl. No. 11/930,700, filed Oct. 31, 2007, Ladner, Robert C., Abandoned.
U.S. Appl. No. 11/930,802, filed Oct. 31, 2007, Ladner, Robert C., Abandoned.
U.S. Appl. No. 11/930,897, filed Oct. 31, 2007, Ladner, Robert C., Abandoned.
U.S. Appl. No. 11/931,810, filed Oct. 31, 2007, Ladner, Robert C., Abandoned.
U.S. Appl. No. 11/931,665, filed Oct. 31, 2007, Ladner, Robert C., Abandoned.
U.S. Appl. No. 11/931,496, filed Oct. 31, 2007, Ladner, Robert C., Abandoned.
U.S. Appl. No. 11/931,361, filed Oct. 31, 2007, Ladner, Robert C., Abandoned.
U.S. Appl. No. 11/932,098, filed Oct. 31, 2007, Ladner, Robert C., Abandoned.
U.S. Appl. No. 11/932,015, filed Oct. 31, 2007, Ladner, Robert C., Abandoned.
U.S. Appl. No. 11/932,184, filed Oct. 31, 2007, Ladner, Robert C., Abandoned.
U.S. Appl. No. 11/931,941, filed Oct. 31, 2007, Ladner, Robert C., Abandoned.
U.S. Appl. No. 11/934,181, filed Nov. 2, 2007, Ladner, Robert C., Abandoned.
U.S. Appl. No. 12/194,758, filed Aug. 20, 2008, McPherson, John M., Pending.
U.S. Appl. No. 12/196,357, filed Aug. 22, 2008, Moscicki, Richard, Abandoned.
U.S. Appl. No. 12/471,875, filed May 26, 2009, Ley, Arthur C., Abandoned.
U.S. Appl. No. 12/683,094, filed Jan. 6, 2010, Sternlicht, Andrew, Published.
U.S. Appl. No. 12/727,637, filed Mar. 19, 2010, Cicardi, Marco, Published.
U.S. Appl. No. 12/951,543, filed Nov. 22, 2010, Ladner, Robert C., Published.
U.S. Appl. No. 13/228,300, filed Sep. 8, 2011, Ladner, Robert C., Published.
U.S. Appl. No. 13/345,170, filed Jan. 6, 2012, Sexton, Daniel J., Published.
U.S. Appl. No. 13/458,086, filed Apr. 27, 2012, Blair, Henry, Published.

(56) References Cited

OTHER PUBLICATIONS

U.S. Appl. No. 13/571,138, filed Aug. 29, 2012, Markland, William, Published.
Nagai et al., "Synthesis of a Bicyclic Dipeptide with the Shape of a-Turn Central Part," Tetrahedron Letters, 26 (5):647-650 (1985).
Nagai, et al., Bicyclic Turned Dipeptide (BTD) as a a-Turn Mimetic; its Design, Synthesis, and Incorporation into Bioactive Peptides, Tetrahedron, 49:3577-3592 (1993).
Nektartm—Transforming Therapeutics, Nektar Advanced PEGylation: Polyethylene Glycol and Derivatives for Advanced PEGylation, pp. 1-24, catalogue 2004.
Nektartm—Transforming Therapeutics, Nektar Molecule Engineering: Polyethylene Glycol and Derivatives for Advanced PEGylation, pp. 1-20, catalogue-2003.
Neuhaus, et al., "Effect of Aprotinin on Intraoperative Bleeding and Fibrinolysis in Liver Transplantation," Lancet, 2: 924-925 (1989).
Ngo et al., "The protein folding problem and tertiary structure prediction, Chapter 14: Computational complexity protein structure prediction, and the Levinthal paradox," pp. 433-440 and 492-495 only (1994).
Ngo, et al., "Computational Complexity, Protein Structure Prediction, and the Levinthal Paradox", The Protein Folding Problem and Tertiary Structure Prediction, Chapter 14, pp. 433-440 and 492-495 only (1994).
Ning, et. al., "Production of recombinant humanized anti-HBsAg Fab fragment from *Pichia pastoris* by fermentation.", J Biochem Mol Biol. ;38(3):294-9. (May 31, 2005).
NM_008455.2 (GI: 236465804): "Plasma kallikrein precursor", GenBank Record created on Dec. 29, 2010 GenBank [online] Bethesda, MD USA: United States National Library of Medicine, retrieved from internet using <URL: http://www.ncbi.nlm.nih.gov/nuccore/236465804?sat=14&satkey=4833839> GenBank Accession No. NM_008455.2 (GI: 236465804).
Nof Corporation, "PEG Derivatives, Phospholipid and Drug Delivery Materials for Pharmaceutical Products and Formulations," pp. 1-59, catalogue Ver. 8—Apr. 2006.
Nof Corporation, "PEG Derivatives, Phospholipid and Drug Delivery Materials for Pharmaceuticals," pp. 1-46, catalogue—2003, 1st.
Nof Corporation, "PEG Derivatives, Phospholipid and Drug Delivery Materials for Pharmaceuticals," pp. 1-50, catalogue—2003 2nd.
Novotney et al., "Purification and Characterization of the Lipoprotein-associated Coagulation Inhibitor from Human Plasma," J. Biol. Chem. 264:18832-18837 (1989).
Novotny et al., "Purification of characterization of the lipoprotein-associated coagulation inhibitor from human plasma," The Journal of Biological Chemistry, 1989, vol. 264, No. 31, pp. 18832-18837.
NP_000217.2 (GI:55956899): "keratin, type I cytoskeletal 9", GenBank Record created on Dec. 27, 2010 GenBank [online] Bethesda, MD USA: United States National Library of Medicine, retrieved from internet using <URL:http://www.ncbi.nlm.nih.gov/protein/55956899?sat=14&satkey=4890700> GenBank Accession No. NP_000217.2 (GI:55956899).
NP_000418.2 (GI:109255251): "loricrin", GenBank Record created on Nov. 3, 2010 GenBank [online] Bethesda, MD USA: United States National Library of Medicine, retrieved from internet using <URL:http://www.ncbi.nlm.nih.gov/protein/109255251?sat=14&satkey=6156833> GenBank Accession No. NP_000418.2 (GI:109255251).
NP_000883.2 (GI: 78191798): "Plasma kallikrein preproprotein", GenBank Record created on Nov. 21, 2010, GenBank [online] Bethesda, MD USA: United States National Library of Medicine, retrieved from internet using <URL:http://www.ncbi.nlm.nih.gov/protein/78191798?sat=14&satkey=4530481> GenBank Accession No. NP_000883.2 (GI: 78191798).
NP_000892 (GI: 158508572): "mineralocorticoid receptor isoform 1", GenBank Record created on Dec. 27, 2010, GenBank [online] Bethesda, MD USA: United States National Library of Medicine, retrieved from internet using <URL:http://www.ncbi.nlm.nih.gov/protein/158508572?sat=14&satkey=4536058> GenBank Accession No. NP_000892.2 (GI: 158508572).
NP_005850.1 (GI:5032007): "transcriptional activator protein Pur-alpha", GenBank Record created on Dec. 28, 2010, GenBank [online] Bethesda, MD USA: United States National Library of Medicine, retrieved from internet using <URL:http://www.ncbi.nlm.nih.gov/protein/5032007?sat=14&satkey=4526134> GenBank Accession No. NP_005850.1 (GI:5032007).
NP_006228.3 (GI:110347449): "POU domain, class 4, transcription factor 1", GenBank Record created on Dec. 27, 2010, GenBank [online] Bethesda, MD USA: United States National Library of Medicine, retrieved from internet using <URL:http://www.ncbi.nlm.nih.gov/protein/110347449?sat=14&satkey=4536081> GenBank Accession No. NP_006228.3 (GI:110347449).
NP_009060.2 (GI:22547197): "zinc finger protein ZIC 2", GenBank Record created on Dec. 24, 2010, GenBank [online] Bethesda, MD USA: United States National Library of Medicine, retrieved from internet using <URL:http://www.ncbi.nlm.nih.gov/protein/22547197?sat=14&satkey=4290853> GenBank Accession No. NP_009060.2 (GI:22547197).
NP_031393.2 (GI:21396480): "RNA-binding protein Raly isoform 2", GenBank Record created on Dec. 25, 2010, GenBank [online] Bethesda, MD USA: United States National Library of Medicine, retrieved from internet using <URL:http://www.ncbi.nlm.nih.gov/protein/21396480?sat=14&satkey=4835374> GenBank Accession No. NP_031393.2 (GI:21396480).
NP_032481.2 (GI: 236465805): "Plasma kallikrein precursor", GenBank Record created on Dec. 29, 2010 GenBank [online] Bethesda, MD USA: United States National Library of Medicine, retrieved from internet using <URL:http://www.ncbi.nlm.nih.gov/protein/236465805?sat=14&satkey=4833839> GenBank Accession No. NP_032481.2 (GI:236465805).
NP_036857.2 (GI:162138905): "Plasma kallikrein precursor", GenBank Record created on Dec. 26, 2010, GenBank [online] Bethesda, MD USA: United States National Library of Medicine, retrieved from internet using <URL:http://www.ncbi.nlm.nih.gov/protein/162138905?sat=14&satkey=5346361> GenBank Accession No. NP_036857.2 (GI:162138905).
NP_056932.2 (GI:153791670): "Plasma kallikrein preproprotein", GenBank Record created on Dec. 27, 2010, GenBank [online] Bethesda, MD USA: United States National Library of Medicine, retrieved from internet using <URL: http://www.ncbi.nlm.nih.gov/protein/153791670?sat=14&satkey=4553701> GenBank Accession No. NP_056932.2 (GI:153791670).
NP_061856.1 (GI:9506713): "H/ACA ribonucleoprotein complex subunit 1", GenBank Record created on Dec. 24, 2010, GenBank [online] Bethesda, MD USA: United States National Library of Medicine, retrieved from internet using <URL:http://www.ncbi.nlm.nih.gov/protein/9506713?sat=14&satkey=4524138> GenBank Accession No. NP_061856.1 (GI:9506713).
NP_065104.1 (GI:9966841): "cell death regulator Aven", GenBank Record created on Dec. 26, 2010, GenBank [online] Bethesda, MD USA: United States National Library of Medicine, retrieved from internet using <URL:http://www.ncbi.nlm.nih.gov/protein/9966841?sat=14&satkey=4843224> GenBank Accession No. NP_065104.1 (GI:9966841).
NP_115818.2 (GI:53829370): "neuralized-like protein 4 isoform 1", GenBank Record created on Dec. 27, 2010, GenBank [online] Bethesda, MD USA: United States National Library of Medicine, retrieved from internet using <URL:http://www.ncbi.nlm.nih.gov/protein/53829370?sat=14&satkey=4560911> GenBank Accession No. NP_115818.2 (GI:53829370).
NP_476429.2 (GI:109148552): "keratin, type II cytoskeletal 3", GenBank Record created on Dec. 24, 2010, GenBank [online] Bethesda, MD USA: United States National Library of Medicine, retrieved from internet using <URL:http://www.ncbi.nlm.nih.gov/protein/109148552?sat=14&satkey=6358709> GenBank Accession No. NP_NP_476429.2 (GI:109148552).
NP_631961.1 (GI:21327701): "TATA-binding protein-associated factor 2N isoform 1", GenBank Record created on Dec. 25, 2010, GenBank [online] Bethesda, MD USA: United States National Library of Medicine, retrieved from internet using <URL: http://www.ncbi.nlm.nih.gov/protein/21327701?sat=14&satkey=4528109> GenBank Accession No. NP_631961.1 (GI:21327701).

(56) References Cited

OTHER PUBLICATIONS

NP_787059.2 (GI:40068462): "AT-rich interactive domain-containing protein 1B isoform 3", GenBank Record created on Mar. 4, 2010, GenBank [online] Bethesda, MD USA: United States National Library of Medicine, retrieved from internet using <URL:http://www.ncbi.nlm.nih.gov/protein/NP_787059.2?report=genpept> GenBank Accession No. NP_787059.2 (GI:40068462).

Nwariaku, et al., "Effect of a bradykinin antagonist on the local inflammatory response following thermal injury" Burns, 22:324-327 (1996).

O'Reilly, et al., "Angiostatin: A Novel Angiogenesis Inhibitor That Mediates the Suppression of Metases by a Lewis Lung Carcinoma," Cell, 79 317-328 (1994).

Okamoto, et al., "A Finding of Highly Selective Synthetic Inhibitor of Plasma Kallikrein; Its Action to Bradykinin Generation, Intrinsic Coagulation and Experimental DIC," Agents Actions Suppl., 38(I):198-205 (1992).

Pan et al., "Reperfusion inury following cerebral ischemia: pathophysiology, MR imaging, and potential therapies," Neuroradiology, 2007, vol. 49, pp. 93-102.

Park, et al., "Three Dimensional Structure of the Kringle Sequence: Structure of Prothrombin Fragment 1," Biochemistry, 25:3977-3982 (1986).

Petersen et al., "Inhibitory propterties of separate recombinant Kunitz-type-protease-inhibitor domains from tissue-factor-pathway inhibitor," Eur. J. Biochem., 1996, vol. 235, pp. 310-316.

Phillips, "The challenge of gene therapy and DNA dellicery," J. Pharm. Pharmacology, vol. 53, pp. 1169-1174 (2001).

Pintigny et al., "Aprotinin can inhibit the proteolytic activity of thrombin: a fluorescence and an enzymatic study," Eur. J. Biochem., 1992, vol. 207, pp. 89-95.

Piro et al., "Role for the Kunitz-3 domain of tissue factor pathway inhibitor-a in cell surface binding," Circulation, 2004, vol. 110, pp. 3567-3572.

Pirollo et al., "Targeted delivery of small interfering RNA: approaching effective cancer therapies," Cancer Res., 2008, vol. 68, No. 5, pp. 1247-1250.

Pitt et al., "Rabbit monoarticular arthritis as a model for intra-articular drug injections. The local action of administered cortisol and a-1 proteinase inhibitor," Agents and Actions, vol. 15, No. 5-6, abstract online, retrieved from internet <URI:http://www.springerlink.com/content/j82860503948741/p> (Dec. 1984).

Polypure, Products; PEG amines; PEG acids and amino acids, PEG thils and disulfides; Biotins, Apr. 2005.

Polypure, Products; PEG amines; PEG acids and amino acids; PEG thiols and disulfides; Biotins, Apr. 2004.

Poznansky et al., "Growth hormone-albumin-conjugates reduced renal toxicity and altered plasma clearance," 1988, vol. 239, pp. 18-22.

Preliminary Report on Patentability from International Application No. PCT/US11/20377 dated Jun. 28, 2011.

Putterman, C., "Aprotinin Therapy in Septic Shock," ACTA Chir. Scand., 155:367 (1989).

Quanta Biodesign, Labeling, Derivatization and Crosslinking Reagents for Biological and Related Materials with dPEGTM, pp. 1-38, Mar. 12, 2004.

Quanta Biodesign, Labeling, Modification and Crosslinking Reagents incorporating our unique monodispersed dPEGTM, pp. 1-31, Nov. 5, 2004.

Quanta Biodesign, Leading innovator, producer and provider of monodisperse discrete PEGTM (dPEGTM) derivatives, Product Catalogue, pp. 1-51, Updated: Nov. 17, 2005.

Rahman et al., "Identification and functional importance of plasma kallikrein in the synovial fluids of patients with rheumatoid, psoriatic, and osteoarthritis," Annals of the Rheumatic Diseases, 1995, vol. 54, pp. 345-350.

Rahman et al., "Identification and functional importance of plasma kallikrein in the synovial fluids of patients with rheumatoid, psoriatic, and osteoarthritis," Annals of the Rheumatic Diseases, vol. 54, pp. 345-350 (1995).

Reichert, "Technology evaluation: lumiliximab, Biogen Idec" Curr Opin Mol Ther., 6(6):675-83 (2004). (Abstract only).

Robbins, K.C. et al., Hemostasis and Thrombosis, Chapter 21, 2nd Edition, Basic Principles and Clinical Practice: 340-357 (1987).

Roberts et al., "Directed evolution of a protein: seleciton of potent neurtophil elastase inhibitor displayed on M13 fusion phage," PNAS USA, vol. 89, pp. 2429-2433 (1992).

Roberts et al., "Protease inhibitor display M13 phage: selection of high-affinity neurtophil elastase inhibitors," Gene, vol. 121, pp. 9-15 (1992).

Roberts, M.J. et al., "Chemistry for peptide and protein PEGylation", Advanced Drug Delivery Reviews, 54, pp. 459-476, 2002.

Rossi, E. et al., The Synthetic Peptide DX88 Binds to Endothelial Cells In Vitro and Retains the Inhibitory Activity on Kallikrein, International Immunopharmacology 2(9):1313, Abstract 142 (2002).

Sainz I.M. et al., "Fifty years of research on the plasma kallikrein-kinin system: from protein structure and function to cell biology and in-vivo pathophysiology" Thromb Haemost 98, 77-83, 2007.

Sartor, R.B., et al., "Selective Kallikrein-Kinin System Activation in Inbred Rats Differentially Susceptible to Granulomatous Enterocolitis," Gastroenterology, 110:1467-1481 (1996).

Scarff et al., "Targeted disruption of SP13/Serpinb6 does not result in development of growth defects, leukocyte dysfunction, or susceptibility to stroke," Molecular and Cellular Biology, May 2004, pp. 4075-4082.

Scatchard, George, The Attractions of Proteins for Small Molecules and Ions, Ann. NY Acad. Sci, 51:660-672 (1949).

Schechter et al, On the Active Site of Proteases, III Mapping the Active Site of Papain; Specific Peptide Inhibitors of Papain, Biochemical and Biophysical Research Communications 32(5):898-902 (1968).

Schechter et al., On the Size of the Active Site on Proteases, I Papain, Biochemical and Biophysical Research Communications 27(2):157-162 (1967).

Schmaier A.H. "Assembly, activation, and physiologic influence of the plasma kallikrein/kinin system" (2008) Int Immunopharmacol8, 161-165.

Schmaier et al., Hemostasis and Thrombosis, Chapter 2, 2nd Edition, Basic Principals and Clinical Practice: 18-38 (1987).

Schmid-Elsaesser, et al., "A critical reevaluation of the intraluminal thread model of focal cerebral ischemia: evidence of inadvertent premature reperfusion and subarachnoid hemorrhage in rats by laser-Doppler flowmetry" Stroke 29 (10): 2162-70 (1989).

Schmidt et al., "A male accessory gland peptide with protease inhibitory activity in *Drosophila funebris*," Swiss-Prot, Accession #P11424 (1992).

Schnabel et al., Aprotinin: Preparation by Partial Desulphurization of Aprotinin by Means of Raney Nickel and Comparison with Other Aprotinin Derivatives, Biol. Chem. Hoppe-Seyler, 367:1167-1176 (1986).

Schopf, "IDEC-114 (IDEC)" Curr Opin Investig Drugs, 2(5):635-8 (2001). (Abstact only).

Schwartz et al., "Stability studies on derivatives of the bovine trypsin inhibitor," Biochemistry, vol. 26, pp. 3544-3551 (1987).

Shearwater Corporation, Polyethylene Glycol and Derivatives for Biomedical Applications, pp. 1-17, catalogue—2001.

Shearwater Polymers, Inc., Polyethylene Glycol and Derivatives, pp. 1-50, catalogue—Jul. 1997.

Shearwater Polymers, Inc., Polyethylene Glycol Derivatives: Functionalized Biocompatible Polymers for Research and Pharmaceuticals, pp. 1-50, catalogue—2000.

Shearwater Polymers, Inc., pp. 2-49, catalogue—Mar. 1995.

Sheppard, et al., Acid-Labile Resin Linkage Agents for Use in Solid Phase Peptide Synthesis, Int. J. Peptide Protein Res., 20:451-454 (1982).

Sheridan, et al., A Multicenter Trial of the Use of the Proteolytic Enzyme Inhibitor Aprotinin in Colorectal Surgery, Dis. Colon Rectum, 32:505-508 (1989).

Shibuya, et. al., "Primary Structure of Guinea Pig Plasma Prekallikrein", Immunopharmacology, vol. 45 (1-3), p. 127-34, Abstract p. 131, Fig 1, 2 (1999).

Siebeck et al., "Inhibition of plasma kallikrein with aprotinin in porcine endotoxin shock," J. Trauma, vol. 34, pp. 193-198 (1993).

(56) References Cited

OTHER PUBLICATIONS

Skolnick et al., "From genes to protein structure and function: novel applications of computational apporaches in the genomic era," Trends in Biotech., 2000, vol. 18, No. 1, pp. 34-39.
Sprecher et al., "Molecular cloning, expression, and partial characterization of a second human tissue-factor-pathway inhibitor," PNAS USA, 1994, vol. 91, No. 8, pp. 3353-3357.
Sprecher et al., "Molecular Cloning, Expression, and Partial Characterization of a Second Human Tissue-Factor-Pathway Inhibitor," Proc. Natl. Acad. Sci. USA, 91:3353-3357 (1994).
Stadnicki et al., "Activation of plasma contact and coagulation systems and neutrophils in the active phase of ulcerative colitis," Digestive Diseases and Sciences, 1997, vol. 42, No. 1, pp. 2356-2366.
Stadnicki et al., "Activation of the Kallikrein-Kinin System in Indomethacin-Induced Entercolitis in Genetically Susceptible Rats," J. Invest. Med., 44:299A (1996).
Stadnicki et al., "Selective Plasma Kallikrein Inhibitor Attenuates Acute Intestinal Inflammation in Lewis Rat," Dig. Dis. Sci., 41:912-920 (1996).
Sunkureddi et al., "Clinical signs of gout," Hospital Physician, 2006, pp. 39-41.
Supplemental European Search Report and Search Opinion from European Application No. 3791557.6 dated Oct. 19, 2007.
Supplemental European Search Report and Search Opinion from European Application No. 7758271.6 dated Jun. 18, 2010.
Supplemental European Search Report from EP App. No. 04786615.7 dated Jan. 20, 2009.
Supplementary Euopean Search Report dated Jan. 19, 2009 from EP App. No. 04782687.0.
Supplementary European Search Report from European Application No. 3757339.1 dated Apr. 23, 2008.
Supplementary European Search Report from European Application No. 8798232 dated Feb. 1, 2012.
Supplementary European Search Report including the European Search Opinion from corresponding European Application No. EP06848187.8, dated Dec. 7, 2009.
Taby et al., "Inhibition of activated protein C by aprotinin and the uses of the insolubilized inhibitor for its purification," Thrombosis Research, 1990, vol. 59, pp. 27-35.
Taggart et al., "Inactiviation of human-b-defensins 2 and 3 by elastolytic cathepsins1," The Journal of Immunology, 2003, vol. 170, pp. 931-937.
Takahashi, et al., "Production of humanized Fab fragment against human high affinity IgE receptor in *Pichia pastoris*" Biosci Biotechnol Biochem 64(10):2138-44 (2000).
Tamura, et al., "Focal cerebral ischaemia in the rat: 1. Description of technique and early neuropathological consequences following middle cerebral artery occlusion" J Cereb Blood Flow Metab 1: 53-60 (1981).
The Merck Index: 145, 263, 427, 428, 1183, and 1184 (1989).
Tian et al., "Synthesis of Optically Pure C?-methyl-arginine," Int. J. Peptide Res., 40:119-126 (1992).
Travis et al., "Pulmonary perspective: potential problems in designing elastase inhibitors for therapy," Am. Rev. Respir. Dig., 1991, vol. 143, pp. 1412-1415.
Churg et al., "Proteases and emphysema," Curr. Opin. Pulm. Med., 2005, vol. 11, pp. 153-159.
Colman et al., Hemostasis and Thrombosis Basic Principles and Clinical Practice, Chapter 1, 2nd Edition, 3-17 (1987).
Colman et al., "The Plasma Kallikrein-Kinin System in Sepsis, Inflammatory Arthritis, and Enterocolitis" Clinical Reviews in Allergy and Immunology, vol. 16, pp. 365-384 (1998).
Colman R. W., "Plasma and tissue Kallikrein in Arthritis and Inflammatory Bowel Disease", Immunopharmacology, Jan. 1, 1999, pp. 103-108, vol. 43, No. 2/03, Elsevier Science Publishers, BV.
Colman RW et al., "Activation of the kallikrein-kinin system in arthritis and enterocolitis in genetically susceptible rats: modulation by a selective plasma kallikrein inhibitor", Proceedings of the Association of American Physicians, Jan. 1, 1997, pp. 10-22, vol. 109, No. 1, Cambridge, MA US.

Colman, "Plasma and tissue kallikrein in arthritis and inflammatory bowel disease," Immunopharmacology, 1999, vol. 43, pp. 103-108.
Colman, et al., "Contact System: A Vascular Biology Modulator With Anticoagulant, Profibrinolytic, Antiadhesive, and Proinflammatory Attributes" Blood, 90, 3819-3843 (1997).
Communication received in EP Patent Application 03791557.6, dated Nov. 27, 2008.
Communication received in EP Patent No. 1 484 339, dated Sep. 29, 2005.
Cumming et al., "Hemodynamic, Renal, and Hormonal Aprotinin in an Ovine Model of Septic Shock," Critical Care Medicine, 20:1134-1139 (1992).
Cunningham et al., "Structural and functional characterization of tissue factor pathway inhibitor following degradation by matrix metalloproteinase-8," Biochem. J., 2002, vol. 367, pp. 451-458.
Currie et al., "Design and Synthesis of a Bicyclic Non-Peptide ?-Bend Mimetic of Enkephalin," Tetrahedron, 49:3489-3500 (1993).
De Haard, et al. "A large non-immunized human Fab fragment phage library that permits rapid isolation and kinetic analysis of high affinity antibodies". J. Biol. Chem 274:18218-30, (1999).
De Wildt, et al., "Characterization of human variable domain antibody fragments against the U1 RNA-associated a protein, selected from a synthetic and patient-derived combinatorial V gene library" Eur J Immunol. 26(3):629-39 (1996).
Debiopharm borchure, "Engineering protein inhibitor of human neutrophil elastase EPIO-hNE4 (DX-890)," Dated Oct. 2004, printed from www.debio.com/e/pdf/fiche_epi_hne4_e.pdf.
Dela Cadena et al., "Inhibition of plasma kallikrein prevents peptidoglycan-induced arthritis in the Lewis rat," FASEB J., 1995, vol. 9, pp. 446-452.
Dela Cadena et al., "Role of Kallikrein-Kinin System in the Pathogenesis of Bacterial Cell Wall-Induced Inflammation and Enterocolitis," Transact. Assoc. Am. Physicians, 105:229-237 (1992).
Dela Cadena, et al., "Inhibition of Plasma Kallikrein Prevents Peptidoglycan-Induced Arthritis in the Lewis Rat," FASEB Journal, 9:446-452 (1995).
Delacourt et al., "Protection against acute lung injury by intravenous or intratracheal pretreatment with EPI-HNE-4, a new potent neutrophil elastase inhibitor," Am. J. Respir. Cell Mol. Biol., Mar. 26, 2002, vol. 26, No. 3, pp. 290-297.
Delaria et al., "Characterization of placental bikunin, a novel human serine protease inhibitor," J. Biological Chemistry, May 2, 1997, vol. 272, No. 18, pp. 12209-12214.
Delgado et al., "The uses and properties of PEG-linked proteins," Critical Review in Therapeutic Drug Carrier Systems, 1992, vol. 9, No. 3,4, pp. 249-304.
Deng, et. al., "Production of recombinant humanized anti-HBsAg Fab antibody by fermentation" Sheng Wu Gong Cheng Xue Bao, 20(5):800-4 (Sep. 2004) (Abstact Only).
Dennis & Lazarus, "Kunitz Domain Inhibitors of Tissue Factor-Factor Vila (I. Potent Inhibitors Selected from Libraries by Phage Display)," Journal of Biological Chemistry 269:22129-22136 (1994).
Dennis & Lazarus, "Kunitz Domain Inhibitors of Tissue Factor-Factor Vila (II. Potent and Specific Inhibitors by Competitive Phage Selection)," Journal of Biological Chemistry, 269:22137-22144 (1994).
Dennis et al., "Potent and Selective Kunitz Domain Inhibitors of Plasma Kallikrein Designed by Phage Display," J. Biol. Chem., 270:25411-25417 (1995).
Devani et al., "Kallikrein-kinin system in inflammatory bowel disease: intestinal involvement and correlation with the degree of tissue inflammation," Digestive and Liver Disease, 2005, vol. 37, pp. 665-673.
Dhalluin et al., "Structural, kinetic, and thermodynamic analysis of the binding of the 40kDa PEG-interferon-a-2a and its individual positional isomers to the extracellular domain of the receptor IFNAR2," Bioconjugate Chemistry, 2005, vol. 16, pp. 518-527.
Diaz et al., "The Design of Water Soluble β-Sheet Structure Based on a Nucleation Strategy,"Tetrahedron, 49:3533-3545 (1993).

(56) References Cited

OTHER PUBLICATIONS

Dimaio et al., "A New Class of Potent Thrombin Inhibitors That Incorporates a Scissile Pseudopeptide Bond," FEBS Lett., 282(1):47-52 (1991).
Dittmar et al., "External carotid artery territory ischemia impairs outcome in the endovascular filament model of middle cerebral artery occlusion in rats" Stroke 34: 2252-7 (2003).
Doerks et al., "Protein annotation: detective work for function prediction," Trends in Genetics, vol. 14, No. 6, pp. 248-250 (1998).
Donnelly et al., "Therapy for chronic obstructive pulmonary disease in the 21st century," Drugs, 2003, vol. 63, pp. 1973-1998.
Dragosits, et. al., "The response to unfolded protein is involved in osmotolerance of *Pichia pastoris*" BMC Genomics. Mar. 26, 2010;11:207.
Dufton, "Protein inhibitors and dendrotoxins," Eur. J. Biochem., vol. 153, pp. 647-654. (1985).
Eigenbrot et al. "Structural Effects Induced by Removal of a Disulfide-Bridge: The X-ray Structure of the C30A/C51A Mutant of Basic Pancreatic Trypsin Inhibitor at 1.6 A," Protein Engineering, 3:591-598 (1990).
Eigenbrot et al., "Structural effects induced by removal of a disulfide-bridge: the X-ray structure of the C20A/C51A mutant of basic pancreatic trypsin inhibitor at 1.6 Å," Protein Engineering, 1990, vol. 3, No. 7, pp. 591-598.
Ellis et al., "The Urokinase Receptor: Involvement in Cell Surface Proteolysis and Cancer Invasion," Ann. NY. Acad. Sci., 667:13-31 (1992).
Enzon Pharmaceuticals, Macromolecular Engineering Technologies, 2004, pp. 1-14.
Extended European Search Report and Search Opinion for 08798517.2 dated Oct. 26, 2010.
Extended European Search Report and Search Opinion from European Application No. 05 799 587.0 dated Nov. 15, 2012.
Extended European Search Report and Search Opinion from European Application No. 10180486.2 dated Feb. 9, 2011.
Extended European Search Report and Search Opinion from European Application No. 10180484.7 dated Feb. 28, 2011.
Extended European Search Report and Search Opinion from European Application No. 10164197.5 dated Oct. 1, 2010.
Extended European Search Report and Search Opinion from European Application No. 8798517.2 dated Oct. 26, 2010.
Extended European Search Report and the European Search Opinion from European Application No. 8018863.4 dated Mar. 18, 2009.
Extended European Search Report from European Application No. 10 72 9465 dated Jan. 18, 2013.
Extended European Search Report from European Application No. 7758271.6 dated Jun. 24, 2010.
Fidler & Ellis, "The Implications of Angiogenesis for the Biology and Chemistry of Cancer Metastasis," Cell, 79:185-188 (1994).
Fields & Noble, "Solid Phase Peptide Synthesis Utilizing 9-fluorenylmethocarbonyl Amino Acids," Int. J. Peptide Protein Research, 35:161-214 (1990).
Fife, et al, "Cartilage matrix glycoprotein is present in serum in experimental canine osteoarthritis" J Clin Invest. 84(5): 1432-1439 (1989).
Fraedrich, et al., "Reduction of Blood Transfusion requirement in Open Heart Surgery by Administration of High Doses of Aprotinin-Preliminary Results," Thorac Cardiovasc Surgeon, 37:89-91 (1989).
Freidinger, et al., "Protected Lactam-Bridged Dipeptides for Use as Conformational Constraints in Peptides," Journal of Organic Chemistry, 47:104-109 (1982).
Fries et al., "Inter-a-inhibitor, hyaluronan and inflammation," Acta Biochimica Polonica, 2003, vol. 50, No. 3, pp. 735-742.
Frisbie, "An animal model for venous thrombosis and spontaneous pulmonary embolism." Spinal Cord 43, 635-639 (2005).
G Yetkin et al: "The healing effect of TGF-[alpha] on gastric ulcer induced by acetylsalicylic acid in rats", International Journal of Pharmaceutics, vol. 277, No. 1-2, Jun. 1, 2004, pp. 163-172.

Galeffi, et. al., "Functional expression of a single-chain antibody to ErbB-2 in plants and cell-free systems" J Transl Med. Sep. 29, 2006;4:39.
Gardell, et al., "The Search for the Ideal Thrombolytic Agent: Maximize the Benefit and Minimize the Risk," Toxicologic Pathology, 21(2):190-198 (1993).
Gerriets et al., "Complications and pitfalls in rat stroke models for middle cerebral artery occlusion: a comparison between the suture and the macrosphere model using magnetic resonance angiography", Stroke 35: 2372-2377 (2004).
Girard et al., "Functional significance of the Kunitz-type inhibitory domains of lipoprotein-associated coagulation inhibitor," Nature, 1989, vol. 338, pp. 518-520.
Girard et al., "Functional Significance of the Kunitz-type Inhibitory Domains of Liporotein-Associated Coagulation Inhibitor," Nature, 338:518-520 (1989).
Girard, et al., "Structure of the Human Lipoprotein-associated Coagulation Inhibitor Gene," The Journal of Biological Chemistry, 266:5036-5041 (1991).
Goldenberg et al., "Circular and circularly permuted forms of bovine pancreatic trypsin inhibitor," J. Mol. Biol., vol. 165, pp. 407-413 (1983).
Gonzalez-Quevedo et al., The Synthetic Kunitz Domain Protein DX88 to Treat Angioedema in Patients with Hereditary Angioedema, International Immunopharmacology 2(9):1318 Abstract 205 (2002).
Goodson et al., "Site-directed PEGylation of recombinant interleukin-2 at its glycosylation site," Bio Technology, 1990, vol. 8, pp. 343-346.
Graham et al., "Animal models of ischemic stroke: balancing experimental aims and animal care", Comp Med 54: 486-496 (2004).
Greilich et al., "Antigibrinolytic therapy during cardiopulmonary bypass reduces proinglammatory cytokine levels: a randomized, double-blind, placebo-controlled study of x-aminocaproic acid and aprotinin," J. Thorac. Cardiovasc. Surg., 2003, vol. 126, pp. 1498-1503.
Grimaldi et al., "Trasylol in the treatment of acute arthritis due to microcrystals," Reumatismo, vol. 23, No. 5, pp. 217-221, (1971) (Abstract only).
Gulberg et al., "Biosynthesis, processing and sorting of neutrophil proteins: insight into neutrophil granule development," Eur. Journal of Haematology, 1997, vol. 58, pp. 137-153.
Guzman et al. "Mono-iodoacetate-induced histologic changes in subchondral bone and articular cartilage of rat femorotibial joints: an animal model of osteoarthritis." Toxicol Pathol. 31(6):619-24 (2003).
Hagihara et al., "Screening for stable mutants with amino acid pairs substituted for the disulfide bond between residues 14 and 38 of bovine pancreatic trypsin inhibitor (BPTI)," The Journal of Biological Chemistry, 2002, vol. 277, No. 52, pp. 51043-51048.
Han, Eun D. et al., Increased Vascular Permeability in C1 Inhibitor-Deficient Mice Mediated by the Bradykinin Type 2 Receptor, J. Clinical Investigation 109(8):1057-1063 (2002).
Han, Eun D. Reversal of the Increased Vascular Permeability in C1 Inhibitor Deficient Mice: Therapeutic Approaches, International Immunopharmacology 2(9):1315 Abstract 176 (2002).
Hanes et al., "Picomolar affinity antibodies from a fully synthetic naive library selected and evolved by ribosome display" Nat Biotechnol. 18:1287-92 (2000).
Herter et al., "Hepatocyte growth factor is a preferred in vitro substrate for the human hepsin, a membrane-anchored serine protease implicated in prostate and ovarian cancers," Biochem. J., 2005, vol. 390, pp. 125-136.
Hoet, et al., "Generation of high-affinity human antibodies by combining donor-derived and synthetic complementarity-determining-region diversity" Nat Biotechnol. 23(3)344-8 (2005).
Hoogenboom et al. "Natural and designer binding sites made by phage display technology" Immunol Today 2:371-8 (2000).
Hoogenboom et al., "Antibody phage display technology and its applications" Immunotechnology 4:1-20 (1998).
Hoover, et al., "Amino Acids of the Recombinant Kringle 1 Domain of Human Plasminogen that Stabilize Its Interaction w-Amino Acids," Biochemistry, 32:10936-10943 (1993).

(56) References Cited

OTHER PUBLICATIONS

Hortin, et al., "Allosteric Changes in Thrombin's Activity Produced by peptides Corresponding to Segments of Natural Inhibitors and Substrates," The Journal of Biological Chemistry, 266:6866-6871 (1991).
Horwitz, et. al., "Secretion of functional antibody and Fab fragment from yeast cells.", Proc Natl Acad Sci U S A. 85(22):8678-82 (Nov. 1988).
Hostomsky, et al., "Solid Phase Assembly of Cow Colostrum Trypsin Inhibitor Gene," Nucleic Acids Research, 15:4849-4856 (1987).
Huang et al., "Kinetics of factor Xa inhibition by tissue factor pathway inhibitor," The Journal of Biological Chemistry, 1993, vol. 268, No. 36, pp. 26950-26955.
Huang et al., "Novel peptide inhibitors of angiotensin-converting enzyme 2," The Journal of Biological Chemistry, 2003, vol. 278, No. 18, pp. 15532-15540.
Huge et al. "A model to investigate postoperative ileus with strain gauge transducers in awake rats" J Surg Res. 74 (2):112-8 (1998). (Abstact Only).
Hynes et al., "X-ray crystal structure of the protease inhibitor domain of alzheimer's amyloid b-protein precursor," Biochemistry, 1990, vol. 29, pp. 10018-10022.
Hynes et al., "X-Ray Crystal Structure of the Protease Inhibitor Domain of Alzheimer's Amyloid, ?-Protein Precursor," Biochemistry, 29:10018-10022 (1990).
International Preliminary Report on Patentability from International Application No. PCT/US2008/073665 dated Feb. 24, 2010.
International Preliminary Report on Patentability from International Application No. PCT/US2008/074061 dated Mar. 4, 2010.
International Search Report from International Application No. PCT/US11/20377 dated Jun. 28, 2011.
International Search report from International Application No. PCT/US2004/028256 dated 2005.
International Search Report from International Application No. PCT/US05/34335 dated Jul. 21, 2008.
International Search Report from International Application No. PCT/US07/63703 dated Dec. 21, 2007.
International Search Report from International Application No. PCT/US12/20470 dated Apr. 30, 2012.
International Search Report from International Application No. PCT/US2008/074061 dated Dec. 29, 2008.
International Search Report from International Application No. PCT/US2010/020257 dated Jun. 1, 2010.
International Search Report from International Application No. PCT/US2008/074061 mailed Dec. 29, 2008.
International Search Report including Written Opinion from International Application No. PCT/08/73665 dated Feb. 5, 2008.
International Search Report including Written Opinion from International Application No. PCT/US08/74061 dated Dec. 28, 2008.
International Search Report of International Application No. PCT/US06/49322 mailed Dec. 7, 2007.
Kanppik et al., "Fully synthetic human combinatorial antibody libraries (HuCAL) based on modular consensus frameworks and CDRs randomized with trinucleotides", J. Mol. Biol. 296:57-86 (2000).
Kaplan, et. al., "A Prealbumin Activator of Preallirrein. 3. Appearance of Chemotactic Activity for Human Neutrophils by the conversion of Human Prekallikrein", J. Exp. Med. vol. 135(1), p. 81-97; p. 92 Fig 10, p. 93 (1972).
Katre et al., "Chemical modification of recombinant interleukin 2 by polyethylene glycol increases its potency in the murine Meth A sarcoma model," PNAS USA, 1987, vol. 84, pp. 1487-1491.
Katre et al., "Immunogenicity of recombinant IL-2 modified by covalent attachment of polyethylene glycol," J. Immunol., 1990, vol. 144, pp. 209-213.
Kaufman, et al., "Amplification and expression of sequences cotransfected with a modular dihydrofolate reductase complementary dna gene", Mol. Biol. 159:601 621 (1982).

Kelly et al., "Diabetes insipidus in uricase-deficient mice: a model for evaluating therapy with poly(ethylene glycol)-modified," J. Am. Soc. Nephrol., 2001, vol. 12, pp. 1001-1009.
Kemp et al., "Synthesis of Peptide-Functionalized Daicylaminoepinodolidiones," Tetrahedron Letters, 29:5077-5080 (1988).
Kido et al., "Kunitz-type Protease Found in Rat Mast Cells," J. Biol. Chem. 263(34):18104-18107 (1988).
Kido et al., "Kunitz-type protease inhibitor found in rat mast cells," The Journal of Biological Chemistry, 1988, vol. 263, No. 34, pp. 18104-18107.
Kido et al., "Protease Specificity of Kunitz Inhibitor Domain of Alzheimer's Disease Amyloid Protein Precursor," Biochemical and Biophysical Research Communications, 167:716-721 (1990).
Kirchhofer et al., "Hepsin activates pro-hepatocyte growth factor and is inhibited by hepatocyte growth factor activator-1B (HAI-1B) and HAI-2," FEBS Letters, 2005, vol. 579, pp. 1945-1950.
Kirchhoff, et al., "A Major Human Epididymis-Specific cDNA Encodes a Protein with Sequence Homology to Extracellular Proteinase Inhibitors," Biology of Reproduction, 45:350-357 (1991).
Kline, et al. "Hirulog Peptides with Scissile Bond Replacements Resistant to Thrombin Cleavage," Biochem. Biophys. Res. Comm., 177:1049-1055 (1991).
Kuno et al., "Possible involvement of neutrophil elastase in impaired mucosal repair in patients with ulcerative colitis," Journal of Gastroenterology, 2002, vol. 37, Supple XIV, pp. 22-32.
Kurjan & Herskowitz, "Structure of a Yeast Pheromone Gene (MF?): a putative ?-Factor Precursor Contains Four Tandem Copies of Mature ?-Factor," Cell, 30: 933-943 (1982).
Laskowski, et al., "Inhibitors with Class-Specific Reactive Sites," Ann. Rev. Biochem., 49:593-626 (1980).
Leatherbarrow, et al., "Design of a Small Peptide-Based Proteinase Inhibitor by Modeling the Active-Site Region of Barley Chymotrypsin Inhibitor 2," Biochemistry, 30:10717-10721 (1991).
Leeb-Lundberg et al. "International union of pharmacology. XLV. Classification of the kinin receptor family: from molecular mechanisms to pathophysiological consequences", (2005) Pharmacol Rev 57, 27-77.
Leonetti et al., "Increasing immunogenicity of antigens fused to Ig-binding proteins by cell surface targeting," The Journal of Immunology, 1998, vol. 160, pp. 3820-3827.
Levy Jerrold H et al: "The therapeutic potential of a kallikrein inhibitor for treating hereditary angioedema.", Expert Opinion on Investigational Drugs Sep. 2006 LNKD-PUBMED:16916274,vol. 15, No. 9, Sep. 2006, pp. 1077-1090.
Ley et al., "Obtaining a Family of High-Affinity, High Specificity Protein Inhibitors of Plasmin and Plasma Kallikrein," Molecular Diversity, 2:119-124, (1996).
Lilla et al., "Active plasma kallikrein localizes to mast cells and regulates epithelial cell apoptosis, adipocyte differentiation, and stromal remodeling during mammary gland involution" J Biol Chem. 284(20):13792-13803 (2009).
Lohmann, et al., Plasmin- and Plasminogen-Activator Inhibitors after Excimer Laser Photorefractive Keratectomy: New Concept in Prevention of Postoperative Myopic Regression and Haze, Refractive and Corneal Surgery, 9:300-302, (1993).
Longa et al., "Reversible middle cerebral artery occlusion without craniectomy in rats" Stroke 20 (1): 84-91 (1989).
Lucas, et al., "The Binding of Human Plasminogen to Fibrin and Fibrinogen," J. Biol. Chem., 258:4249-4256 (1983).
Lumry et al, Interim Results of EDEMA2, A Multicenter, Open-Label, Repeat-Dosing Study of Intravenous and Subcutaneous Administration of Ecallantide (DX-88) in Hereditory Angioedema. J. Allergy and Clinical Immunology 117(2)(Suppl. 1):S179 Abstract 699 (2006).
MacGilchrist, "Effect of the Serine Protease Inhibitor, Aprotinin, on Systemic Haemodynamics and Renal Function in Patients with Hepatic Cirrhosis and Ascites," Clin. Sci., 87:329-335 (1994).
Magklara et al., "Characterization of the enzymatic activity of human kallikrein 6: autoactivation, substrate specificity and regulation by inhibitors," Biochem. Biophys. Res. Commun., Aug. 8, 2003, vol. 307, No. 4, pp. 948-955, Abstract Only.

(56) References Cited

OTHER PUBLICATIONS

Mann et al., Hemostasis and Thrombosis, Chapter 10, 2nd Edition, Basic Principles and Clinical Practice: 148-161 (1987).
Mannucci, "Hemostatic Drugs" New England Journal of Medicine, Drug Therapy, 339(4):245-253 (1998).
March, Advanced Organic Chemistry, 3rd Edition, Reactions, Mechanisms, and Structure, John Wiley and Sons, New York: 396-398; 1057-1060; 1099-1100 (1985).
Markland et al., "Iterative Optimization of High-Affinity Protease Inhibitors Using Phage Display. 1. Plasmin," Biochemistry, 35:8045-8057 (1996).
Markland et al., "Iterative Optimization of High-Affinity Protease Inhibitors Using Phage Display. 2. Plasma Kallikrein and Thrombin," Biochemistry 35(24):8058-67 (1996).
Markland et al., "Selection for protease inhibitors using bacteriophage display," Methods Enzymol., 1996, vol. 267, pp. 28-51.
Markland et al., "Selection for Protease Inhibitors Using Bacteriophage Display," Methods Enzymol., 267:28-51 (1996).
Mathews, et al., Biochemistry, The Benjamin Cummins Publishing Co., Inc. Redwood City CA: 208-212 (1990).
Mattheakis et al. "An in vitro polysome display system for identifying ligands from very large peptide libraries" Proc. Natl. Acad. Sci. USA 91:9022 (1994).
Maxfield et al., "Conformation of poly(ethylene oxide) in the solid state, melt and solution measured by Raman scattering," Polymer, 1975, vol. 16, pp. 505-509.
McCarty, "Crystal-induced inflammation of the joints," Annual Reviews of Medicine, vol. 21, pp. 357-366 (1970).
McConnell et al., "New Leupeptin Analogues: Synthesis and Inhibition Data," J. Med. Chem., 33:86-93 (1990).
Merriam-Webster reference for the term "prevent." web date: 2010. 2 pages.
Merrifield, "Solid Phase Peptide Synthesis. I. The Synthesis of a Tetrapeptide," Am. Chem. Soc. 85:2149-2154 (1963).
Mine et al., "Structural mechanism for heparin-binding of the third Kunitz domain of human tissue factor pathway inhibitor," Biochemistry, 2002, vol. 41, pp. 78-85.
Miyajima, et al., Secretion of Mature Mouse Interleukin-2 by *Saccharomyces cerevisiae*: Use of a General Secretion vector Containing Promoter and Leader Sequences of the Mating Pheromone a-factor, Gene, 37:155-161 (1985).
Molineux, "Pegylation: engineering improved pharmaceuticals for enhanced therapy," Cancer Treatment Reviews, 2002, vol. 28, pp. 13-16.
Monteseirin, et al., "Plasma Kallikrein Amidolytic Activity in Bronchial Asthma," Allergol. Immunopathol., (Madr)., 20:211-214 (1992).
Moreland, "Intra-articular hyaluronan (hyaluronic acid) and hylans for the treatment of osteoarthritis: mechanisms of action," Arthritis Res. Ther., 2003, vol. 5, pp. 54-67.
Murkin et al., "Aprotinin significantly decreases bleeding and transfusion requirements in patients receiving aspirin and undergoing cardiac operations," J. Thorac. Cardiovasc. Surg., vol. 107, pp. 554-561 (1994).
Naess, et al., "Effects of a Combined Drug Regimen on Tumour Necrosis Factor and Plasma Kallikrein Activity in Experimental Endotoxaemia," Eur J. Surg., 160:77-86 (1994).
Tremblay et al., "Anti-inflammatory activity of neutrophil elastase inhibitors," Current Opinion in Investigational Drugs, 2003, vol. 4, No. 5, pp. 556-565.
Tschesche et al., "Semisynthetic engineering of proteinase inhibitor homologues," Biochim. Biophys. Acta, vol. 913, pp. 97-101 (1987).
Uebel, "Die behandlung con kniegelenksarthrosen mit trasylol," Langenbacks Arch. Chir., vol. 325, pp. 356-358 (1969).
Urlaub et al., "Isolation of Chinese hamster cell mutants deficient in dihydrofolate reductase activity", Proc. Natl. Acad. Sci. USA 77:4216-4220 (1980).
Van Der Logt et al., "Intron-Exon Organization of the Human Gene Coding for the Lipoprotein-associated Coagulation Inhibitor: The Factor Xa Dependent of Inhibitor of the Extrinsic Pathway of Coagulation," Biochemistry, 30:1571-1577 (1991).
Van Dijl et al., "Signal Peptidase 1 of *Bacillus subtillis*: Patterns of Conserved Amino Acids in Prokaryotic and Eukaryotic Type 1 Signal Peptidases," The EMBO Journal, 11:2819-2828 (1992).
Varadi et al., "Location of Plasminogen-Binding Sites in Human Fibrin(ogen)," Biochemistry, 22:2440-2446 (1983).
Varadi, et al., Segment of Fibrinogen is in a Region Essential for Plasminogen Binding by Fibrin Fragment E, Biochemistry, 23:2108-2112 (1984).
Vedvick, et al., "High-Level Secretion of Biologically Active Aprotinin from the Yeast Pichia Pastoris," J. Ind. Microbiol., 7:197-201 (1991).
Veronese, "Peptide and protein PEGylation: a review of problems and solutions," Biomaterials, Mar. 1, 2001, vol. 22, No. 5, pp. 405-417.
Vidal et al., "Making sense of antisense," European Journal of Cancer, 2005, vol. 41, pp. 2812-2818.
Viswanathan M. et al., "Engineered protein protease inhibitors", Current Enzyme Inhibition, Jan. 1, 2009, pp. 87-98, vol. 5, No. 2, Betham Science Publishers Ltd., Hilversum, NL.
Volpe-Junior et al., "Augmented plasma and tissue kallikrein like activity in synovial fluid of patients with inflammatory articular diseases," Inflamm. Res., 1996, vol. 45, pp. 198-202.
Wade, et al., "Solid-Phase Synthesis of ?-Human Atrial Natriuretic Factor: Comparison of the Boc-Polystyrene and Fmoc-Polyamide Methods," Biopolymers, 25: S21-S37 (1986).
Wagner et al., High Level Expression, Purification, and Characterization of the Kunitz-Type Protease Domain of Protease Nexin-2/Amyloid ?-Protein Precursor, Biochemical and Biophysical Research Communications, 186: 1138-1145 (1992).
Wang et al., "Monitoring of heparin-induced anticoagulation with kaolin-activated clotting time in cadiac surgical patients treated with aprotinin," Anesthesiology, vol. 77, pp. 1080-1084 (1992).
Wark P.A., "DX-890 (Dyax)", iDrugs, 5, pp. 586-589, Jun. 2002.
Wellington et al., "Tranexamic Acid: A review of its use in the management of menorrhagia", Drugs, vol. 63, No. 13, pp. 1417-1433, 2003.
Wells, "Addivity of Mutational Effects in Proteins", Biochemistry, vol. 29 (37), pp. 8509-8517 (1990).
Wendel et al., Lower Cardiac Troponin T Levels in Patients Undergoing Cardiopulmonary Bypass and Receiving High-Dose Aprotinin Therapy Indicate Reduction of Perioperative Myocardial Damage; Journal of Thoracic Cardiovascular Surgery, vol. 109, No. 6, pp. 1164-1172 (1995).
Wilson, et al., "The Calculation and Synthesis of a Template Molecule," Tetrahedron, 49:3655-3663 (1993).
Worthy et al., "Current status review kallikreins and kinins: mediators in inflammatory joint disease," Int. J. Exp, 1990.
Worthy, K. et al., "Kallikreins and Kinins: Mediators in Inflammatory Joint Disease?", International Review of Experimental Pathology, pp. 587-601, vol. 71, No. 4, Blackwell Scientific, Oxford GB (Aug. 1, 1990).
Written Opinion from International Application No. PCT/US05/34335 dated Jul. 21, 2008.
Written Opinion from International Application No. PCT/US11/20377 dated Jun. 28, 2011.
Written Opinion from International Application No. PCT/US2008/074061 dated Dec. 29, 2008.
Wun et al., "Cloning and Characterization of a cDNA Coding for the Lipoprotein-associated Coagulation Inhibitor Shows that it Consists of Three Tandem Kunitz-type Inhibitory Domains," J. Biol. Chem. 263:6001-6004 (1988).
Wun et al., "Cloning and characterization of a cDNA coding for the lipoprotein-associated coagulation inhibitor shows that it consists of three tandem Kunitz-type inhibitory domains," The Journal of Biological Chemistry, 1988, vol. 263, No. 13, pp. 6001-6004.
XP_376532.2 (GI:51465288): "Predicted: KIAA0408", GenBank Record created on Aug. 19, 2004, GenBank [online] Bethesda, MD USA: United States National Library of Medicine, retrieved from internet using <URL:http://www.ncbi.nlm.nih.gov/protein/XP_376532.2?report=genpept> GenBank Accession No. XP_376532.2 (GI:51465288).

(56) References Cited

OTHER PUBLICATIONS

Abuchowski et al., "Alteration of immunological properties of bovine serum albumin by covalent attachment of polyethylene glycol," J. Bio. Chem., 1977, vol. 252, pp. 3578-3581.
Abuchowski et al., "Cancer therapy with chemically modified enzymes, I., Antitumor properties of polyethylene glycol-asparaginase conjugates," Cancer Biochem. Biophys., 1984, vol. 7, pp. 175-186.
Abuchowski et al., "Effect of covalent attachment of polyethylene glycol on immunogenicity and circulating life of bovine," J. Biol. Chem., 1977, vol. 252, pp. 3582-3586.
Adams et al: "The role of viscosupplementation with hylan G-F 20 (Synvisc(R)) in the treatment of osteoarthritis of the knee: a Canadian multicenter trial comparing hylan G-F 20 alone, hylan G-F 20 with non-steroidal anti-inflammatory drugs (NSAIDs) and NSAIDs alone", Osteoarthritis and Cartilage, Bailliere Tindall, London, GB, vol. 3, No. 4, pp. 213-225, (Dec. 1, 1995).
Adelman, et al., Proteolysis of Platelet Glycoprotein lb by Plasmin Is Facilitated by Plasmin Lysine-Binding Regions, Blood, vol. 68 (6): 1280-1284, (Dec. 1986).
Alberto Migliore et al: "Open pilot study of ultrasound-guided intra-articular injection of hylan G-F 20 (Synvisc) in the treatment of symptomatic hip osteoarthritis", Clinical Rheumatology; Journal of the International League of Associations for Rheumatology, Springer-Verlag, LO, vol. 24, No. 3, pp. 285-289 (Jun. 1, 2005).
Albrecht, et al., Kunitz-Type Proteinase Inhibitors Derived by Limited Proteolysis of the Inter-?-Trypsin Inhibitors From several Mammalian Sera, Hoppe-Seyler's Z. Physiol. Chem., vol. 364: 1703-1708, (Dec. 1983).
Albrecht, et al.., Elastase Inhibition by the Inter-?-Trypsin Inhibitor and Derived Inhibitors of Man and Cattle, Hoppe-Seyler's Z. Physiol. Chem., vol. 364: 1697-1702, (Dec. 1983).
Anba, et al., Improving the Stability of a Foreign Protein in the Periplasmic Space of *Escherichia coli*, Biochimie, vol. 70(6): 727-733, (1988).
Angliker, et al., The Synthesis of Lysylflouromethanes and their Properties as Inhibitors of Trypsin, Plasmin and Cathepsin B, Biochemistry, 241:871-875, (1987).
Asano M. et al., "Effects of a nonpeptide bradykinin B2 receptor antagonist, FR167344, on different in vivo animal models of inflammation", Br J Pharmacol, vol. 122, p. 1436-1440 (1997).Asano M. et al., Br J Pharmacol, vol. 122, p. 1436-1440 (1997).
Atherton, et al., Peptide Synthesis. Part 2. Procedures for Solid Phase Synthesis using N?-Fluorenylmethycarbonylamino-acids on Polyamide Supports. Synthesis of Substance P and of Acyl Carrier Protein 65-74 Decapeptide, J. Chem. Soc. Perkins Trans, 1:538-546, (1981).
Attwood, The Babel of Bioinformatics; Science, vol. 290, pp. 471-473 (2000).
Auerswald et al., Expression, Isolation and Characterization of Recombinant [Arg15, Glu52] Aprotinin, Bio. Chem. Hoppe-Seyler, 369:(Suppl)27-35 (1988).
Baba, M et al., States of Tyrosyl Residues and Circular Dichroism of Kunitz Trypsin Inhibitor, J. Biochem 65 (1):113-121 (1969).
Balduyck, et al., Human Urinary Proteinase Inhibitor: Inhibitory Properties and Interaction with Bovine Trypsin, Bio. Chem. Hoppe-Seyler, vol. 366: 9-14, (1985).
Baneyx et al., Construction and Characterization of *Escherichia coli* Strains Deficient in Multiple Secreted Proteases: Protease III Degrades High-Molecular-Weight Substrates In Vivo, J Bacteriol., 173:2696-2703 (1991).
Baneyx et al., "In Vivo Degradation of Secreted Fusion Proteins by the *Escherichia coli* Outer Membrane Protease OmpT", J. Bacteriol., 172:491-494, (1990).
Basu et al., "Structure-function engineering of interferon-b-1b for improving stability, solubility, potency, immunogenicity, and pharmacokinetic properties by site-selective mono-PEGylation," Bioconjugate Chemistry, 2006, vol. 17, pp. 618-630.
Bayes et al., "Gateways to Clinical Trials" Methods Find Exp. Clin. Pharmacol., vol. 28(3): pp. 185-206 (2006).

Beckmann et al., "Preparation of chemically 'mutated' aprotinin homologues by semisynthesis-P1 substitutions change inhibitory specificity," Eur. J. Biochem., vol. 176, pp. 675-682 (1988).
Berge, S.M., et al., "Pharmaceutical salts", J. Pharm. Sci. 66:1-19 (1977).
Bergthorsdottir et al., "Signals that initiate somatic hypermutation of B cell in vitro", J. Immunol., p. 166:2228 (2001).
Berndt, et al.,"Designed Replacement of an Internal Hydration Water Molecule in BPTI: Structural and Functional Implications of a Glycine-to-Serine Mutation," Biochemistry, 32: 4564-4570 (1993).
Bhoola et al., "Bioregulation of Kinins: Kallikreins, Kininogens and Kininases," Pharmacological Reviews, 44 :1-80 (1992).
Blaber et al., "Targeting kallikrein 6-proteolysis attenuates CNS inflammatory disease,"The FASEB Journal, express article published online Mar. 19, 2004.
Bork, "Powers and pitfalls in sequence analysis: the 70% hurdle," Genome Research, vol. 10, pp. 398-400 (2000).
Borregaard et al., "Granules of the human neutrophilic polymorphonuclear leukocyte," Blood, 1997, vol. 89, No. 10, pp. 3503-3521.
Bowdish K, et. al., "Yeast expression of a catalytic antibody with chorismate mutase activity.", J Biol Chem.; 266 (18):11901-8 (Jun. 25, 1991).
Branden et al., "Prediction, Engineering, and Design of Protein," Introduction to Protein Structure, 1991, pp. 247, Garland Publishing Inc., New York.
Brenner, "Errors in genome annotation," Trends in Genetics, vol. 15, No. 4, pp. 132-133 (1999).
Brinkmann et al., "Design of an aprotinin variant with inhibitory activity against chymotrypsin and cathepsin G by recombinant DNA technology," Biol. Chem. Hoppe-Seyler, vol. 371, pp. 43-52 (1990).
Browne et al., "Expression of Recombinant Human Plasminogen and Aglycoplasminogen in HeLa Cells," Genebank, Accession No. M74220 (1991).
Broze et al., "Regulation of Coagulation by a Multivalent Kunitz-Type Inhibitor," Biochemistry, 29:7539-7546, (1990).
Brus et al., "Disease Severity Is Correlated with Plasma Clotting and Fibrinolytic and Kinin-Kallikrein Activity in Neonatal Respiratory Distress Syndrome," Pediatric Research, 41:120-127, (1997).
Buchan et al., "A new model of temporary focal neocortical ischemia in the rat", Stroke 23 (2): 273-9 (1992).
Budavari, ed., Merck index, 11th ed., ISBN 911910-28-X, entries 923, 1745, 2740, 7425, (1989).
Burrage et al., "Matrix metalloproteinases: role in arthritis," Fronteirs in Bioscience, 2006, vol. 11, pp. 529-543.
Cantor et al., "Elastin and elastases in lung disease," 1989, Chapter 16, vol. II, pp. 159-168.
Cantor, J.O., et al., "Elastin and Elastases in Lung Disease", Elastin and Elastases, Chapter 16, vol. II, pp. 159-168 (1989).
Carey et al., Advanced Organic Chemistry, 3rd Edition, Part B: Reactions and Synthesis, Plenum Press, New York: 678-686 (1990).
Carmichael, "Rodent models of focal stroke: size, mechanism, and purpose", NeuroRx 2: 396-409 (2005).
Carpenter et al., "Rational design of stable lyophilized protein formulations: theory and practice," Parmaceutical Biotechnology, vol. 13, pp. 109-133 (2002).
Casati et al., "Cardiopulmonary support and physiology—tranexamic acid compared with high-dose aprotinin in primary elective heart operations: effects on perioperative bleeding and allogeneic transfusions," The Journal of Thoracic and Cardiovascular Surgery, vol. 120, pp. 520-527 (2000).
Cassim et al., "Kallikrein cascade and cytokines in inflamed joints," Pharmacology and Therapeutics, 2002, vol. 94, pp. 1-34.
Cernak, "Animal models of head trauma", NeuroRx. 2(3): 410-422 (2005).
Chen et al., "A model of focal ischemic stroke in the rat: reproducible extensive cortical infarction", Stroke 17 (4): 738-43 (1986).
Chen et al., "Refined 2-5 A X-ray Crystal Structure of the Complex Formed by Porcine Kallikrein A and the Bovine Pancreatic Trypsin Inhibitor—Crystallization, Patterson Search, Structure Determination, Refinement, Structure and Comparison with its Components

(56) References Cited

OTHER PUBLICATIONS and with the Bovine Trypsin-Pancreatic Trypsin Inhibitor Complex" J. Mol. Biol., 164:283-311 (1983).
Chen et al., Solution Structure of a Kunitz-type Chymotrypsin Inhibitor Isolated from the Elapid Snake *Bungarus fasciatus*, J. Biological Chemistry 276:45079-45087 (2001).
Chung et al., "Human plasma prekallikrein, a zumogen to a serine protease that contains four tandem repeats," GenBank, Accession #P03952 (1986).
Veloso et al., A monoclonal anti-human plasma prekallikrein antibody that inhibits activation of prekallikrein by factor XIIa on a surface. Blood. 1987 Oct;70(4):1053-62.

\* cited by examiner

```
X63-G06    CAAGACATCCAGATGACCCAGTCTCCAGGCACCCTGTCTTTGTCTCCAGGGGAAAGAGCC
X81-B01    ---GAGATCGTGCTGACCCAGTCCCCTGCCACCCTGTCTCTGTCTCCCGGCGAGAGAGCC
**  ***   * ****** ** ** ************ ** ** ***** ** *******

X63-G06    ACCCTCTCCTGCAGGACCAGTCAATTGTTAACAGCAACTACTTAGCCTGGTACCAACAG
X81-B01    ACCCTGTCCTGCGCCCGGAGCCAGTCCCCAGTTGTCGTGAACTCCAACTACCTGGTATCAGCAG
*****  ***** **  ** *** *  **  **   *  ***  *** ** ** *****

X63-G06    ACACCTGGCCAGGCTCCCCAGGCTCCTCATCTATGTGCATCCAGCAGGGCCACTGGCATC
X81-B01    AAGCCAGGCCAGGCCCAGGCCCCCTAGACTGCTGATCTACGGCGCCTCTTCCAGAGCCACCGGCATC
*  ** ****** ** *** **   ** **  * ** *   *   *   ******* ***

X63-G06    CCAGACAGGTTCAGTGGCACTGGGTATGGGACAGATTCACTCTCACCATCAGCAGACTG
X81-B01    CCTGACCGGTTCTCCGGCTCTGGCTCTGGCACCGACTTCACCCTGACCATCTCCCGGCTG
** *** *****  ***  ***  * *** ** ** ***** ** **  ***  ** ***

X63-G06    GAGCCCTGAAGAGATTATGGAACTTACTACTGTCAGCAGAGTTCCAGAACCCCGTGGACGTTC
X81-B01    GAACCTGAGGACTTCGCCGTGTACTACTGCCAGCAGTCCTCCCGGACCCCCCTTGGACCTTT
**  **  **  * **  **  * ** ** ** ***** ***  **** *  *** ** **

X63-G06    GGCCAAGGGACCAGAGTGGAAATCAAA
X81-B01    GGCCAGGGCACCAAGGTGGAGATCAAG
*****  ** ***   ***** ******
```

FIGURE 4

```
X63-G06   QDIQMTQSPGTLSLSPGERATLSCRTSQFVNSNYLAWYQQTPGQAPRLLIYGASSRATGI
X81-B01   -EIVLTQSPGTLSLSPGERATLSCRTSQFVNSNYLAWYQQKPGQAPRLLIYGASSRATGI
            * **********************************  ********************

X63-G06   PDRFSGTGYGTDFTLTISRLEPEDYGTYYCQQSSRTPWTFGQGTRVEIK
X81-B01   PDRFSGSGSGTDFTLTISRLEPEDFAVYYCQQSSRTPWTFGQGTKVEIK
          ******  * ************* * ****************** ***
```

FIGURE 5

```
X81-B01    GAGGTCAATTGCTGGAATCCGGCGGGAGGTCTGGTGTCAGCCTGGCGGCTC
X63-G06    GAAGTTCAATTGTTAGAGTCTGGTGGCGGTCTTGTTCAGCCTGGTGGTTC
           ** ** ******** * ***** ********** ** ******* ** **

X81-B01    CCTGAGACTGTCTTGCGCGCCTCCGGCTTCACCTTCTCCCACTACCTGA
X63-G06    TTTACGTCTTTCTTGCGCCTGCTTCCCGATTCACTTCTCTCTCATTACCTTA
           *  *  ****** ******  * **  * **** ***** * ** ** *

X81-B01    TGACCTGGGTGCGCCAGGCTCCTGGCAAGGGCCTCGAATGGGTGTCCTAC
X63-G06    TGACTTGGGTTCGCCAAGCTCCTGGTAAAGGTTTGGAGTGGGTTTCTTAT
           **** *****  *****  ****** ** *    **  ***** ** **

X81-B01    ATCTCCCCCTCTGCCGCCACCATCTACGCCGACTCCGTCAAGGGCCG
X63-G06    ATCTCTCTTCTGGTGCCATACTATTTATGCTGACTCCGTTAAAGGTCG
           *****  * **  **** *** ** *  **  ******* ** ** **

X81-B01    GTTCACCATCTCCCGGGACAACTCCAAGAACACCCTGTATCTGCAGATGA
X63-G06    CTTCACTATCTCTAGAGACAACTCTAAGAATACTCTCTACTTGCAGATGA
           ****** *****    ******** ***** ** ** ** ********

X81-B01    ACTCCCTGAGGGCCGAGGACACCGCCGTGTACTACTGCGCCAGGGTGGCC
X63-G06    ACAGCTTAAGGGCTGAGGACACGGCCGTGTATTACTGTGCGAGAGTGGCC
           **    * ***** ******** ********  ****  *  ******

X81-B01    AGAGGAATCGCGCGCCAGGTCCCGGACCTCCTACTGACTACTGGGGCCA
X63-G06    CGGGGGATAGCAGCTCGATCGCGAACCAGCTACTTGACTACTGGGGCCA
           * ***  *  *  *    **  **  **  ***** *************

X81-B01    GGGCACCCTGGTGACCGTGTCCTCC
X63-G06    GGGAACCCTGGTCACCGTCTCAAGC
           *** ********  *** *** **
```

FIGURE 6

```
X81-B01    EVQLLESGGGLVQPGGSLRLSCAASGFTFSHYLMTWVRQAPGKGLEWVSY
X63-G06    EVQLLESGGGLVQPGGSLRLSCAASGFTFSHYLMTWVRQAPGKGLEWVSY
           *************************************************

X81-B01    ISPSGGHTIYADSVKGRFTISRDNSKNTLYLQMNSLRAEDTAVYYCARVA
X63-G06    ISPSGGHTIYADSVKGRFTISRDNSKNTLYLQMNSLRAEDTAVYYCARVA
           *************************************************

X81-B01    RGIAARSRTSYFDYWGQGTLVTVSS
X63-G06    RGIAARSRTSYFDYWGQGTLVTVSS
           *************************
```

```
                @@3@@3@@@@@@3
                +-+-+++++++-+(C2)    ++++++++-++(C3)                                  +-++++
Human  SQIKEIIIEQNYKV$EG-NHEIALLKQAPLNYTEFQKPICLPSKGDTSIYTYNCRVTGW  522
Cow    SQIKEIVEPNYKISEG-SHDIALIKLEAPLNFTDLQKAICLPSRDDTKPVYTDCRIIGW  523
Mouse  SRIKELIIEQEEKVSEG NYDIALLKLQTPLNYTEFQRPICLPSKADTNIIYNCRVTGW  522
Rat    SSIKELIIEQKYKYSEG-SYDIALLKLQTPLNYTEFQKPICLPSKADTNIIYNCRVTGW  522
Pig    SQVKEIIIEQNYKILES-GHDIALLKLETPLNYTDFQKPICLPSRDDTNVVYTNCRVTGW  530
Frog   SELEKIIIEPHYTGAGN-GSDIALLKIKTPIVFNDHQKAICLPPSEATLVLPNSCRIIGW  524
MACACA SQIKEIIIEQNYRISES-NHDIALIKLQAPLNYTEFQKPICLPSKGDTNIIYNCRVTGW  525
Dog    SQIKEIIIEQNYKITDGGSYDIALIKLEAPLNYTEFQKPICLPSKDDTNTIYTNCRVTGW  516
         *:::*:      *      *::**:*::*:  :: **.*****.    ..**:***

@@@@@@@3@@3@@                  3@@3@@@@@@3@@
                ++++++++++(C4)      ++++++++++++++++++(C5)         ++++++++++(C6)
Human  GTSKEKGEEQNILQKVNIPLV-NEECCKRYQDVKITQQMVCAGYKEGGKDACKGDSGGPL  582
Cow    GF EEKGKIQN LQKANIPLISNEECCKSYRDYKITKQMICAGYKEGGKDACKGDSGGPL  583
Mouse  GYTKEQGE QNILQKAIIPLVPNEECCKKYRDYVINKQMICAGYKEGIDACKGDSGGPL   582
Rat    GYTKERGE QNILQKAIIPLVPNEECCKKYRDYVITKQMICAGYKEGGIDACKGDSGGPL  582
Pig    GF EEKGEIQNILQKVNIPIVSNEECCKSYRDHKTSKQMICAGYKEGGKDACKGESGGPL  590
Frog   GY TEE GSFGNVLQKAEVPPISTEECCGSYVETRIDKKVLCAGYKSGKIDACKGDSGGPL  584
MACACA GFSKEKGEIODILQKVNIPLV-NEECCKRYQDYKITQRMVCAGYKEGGKDACKGDSGGPL  585
Dog    GF-KERGEIQNSLQKANIPIVPNEECCKKYRDYEVVNKQMICAGYKEGGKDACKGDSGGPL  576
         *  ::* *.   ***  * :.:*** :: *  :  :  :::*** : . ******:****

@@@@@3@@3@@3
                ++++(C7)
Human  VCXHMGMWRLVGIISWGEGCARRHQPGVYIKVAEYMDWILEKIQSSDGKAQMQSPA      638
Cow    VCQHEETWKEIVGIISWGEFGCARREQPGVYIKVAEVVDWILEKIQDSHGQPLRK---    636
Mouse  VCXHSGRMQLVGIISWGEGCGSKMDQPGVYIKVSEYMDWILEKIQSSDVRALETSSA    638
Rat    VCXHSGRMQLVGIISWGEGCARKEQPGVYIKVAEYIDWILEKIQSSKERALETSPA    638
Pig    VCYNGIWELVGIISWGEGCARREQPGVYIKVIEYMDWILEKIQDDDGQSWMK----    643
Frog   VCEVDEIKYLIGIISWGEGCARPGKPGVYIRVSTFTNWILEHIKL--------    629
MACACA ACXHNGMMKLVGIISWGEGCARREQPGVYIKVAEYMDWILERTQSSDGNARMQAPA    641
Dog    VCXHAGNWLLVGIISWGELGCGRHQPGVYIKVAEVVDWILEKIQVGDGHAGLG      629
         .* :   *  * :* ********:* :  :*****:           :
```

FIGURE 10C

NOTE: The underlined positions are the amino acids that form the catalytic triad (His434, Asp483, and Ser578, numbering based on the human sequence).

PLASMA KALLIKREIN BINDING PROTEINS

This application claims priority to U.S. Application Ser. No. 61/292,614, filed on Jan. 6, 2010. The disclosure of the prior application is considered part of (and is incorporated by reference in) the disclosure of this application.

BACKGROUND

Plasma kallikrein is a serine protease. Prekallikrein is the precursor of plasma kallikrein.

SUMMARY

Plasma kallikrein is a serine protease component of the contact system and a potential drug target for different inflammatory, cardiovascular, infectious (sepsis) and oncology diseases (Sainz I. M. et al., Thromb Haemost 98, 77-83, 2007). The contact system is activated by either factor XIIa upon exposure to foreign or negatively charged surfaces or on endothelial cell surfaces by prolylcarboxypeptidases (FIG. 1) (Sainz I. M. et al., Thromb Haemost 98, 77-83, 2007). Activation of the plasma kallikrein amplifies intrinsic coagulation via its feedback activation of factor XII and enhances inflammation via the production of the proinflammatory nonapeptide bradykinin. As the primary kininogenase in the circulation, plasma kallikrein is largely responsible for the generation of bradykinin in the vasculature. A genetic deficiency in the C1-inhibitor protein (C1-INH), the major natural inhibitor of plasma kallikrein, leads to hereditary angioedema (HAE). Patients with HAE suffer from acute attacks of painful edema often precipitated by unknown triggers (Zuraw B. L. et al., N Engl J Med 359, 1027-1036, 2008). Through the use of pharmacological agents or genetic studies in animal models, the plasma kallikrein-kinin system (plasma KKS) has been implicated in various diseases.

Plasma kallikrein binding proteins (e.g., antibodies, e.g., inhibitory antibodies) are useful therapeutic agents for a variety of diseases and conditions, e.g., diseases and conditions that involve plasma kallikrein activity, due to their high potency, specificity, and prolonged serum residency. High potency can translate to efficacy and a low drug dosage, and high specificity can reduce side effects due to the inhibition of related off target serine proteases. In general, small molecule serine proteases are not as specific as antibody inhibitors. Prolonged serum residency can permit infrequent dosing.

In some aspects, the disclosure features an isolated protein (e.g., antibody, e.g., human antibody) that binds to the active form of plasma kallikrein (e.g., human plasma kallikrein and/or mouse plasma kallikrein), and, e.g., does not bind pre-plasma kallikrein (e.g., human preplasma kallikrein and/or mouse preplasma kallikrein).

In some embodiments, the plasma kallikrein binding protein binds the same epitope or competes for binding with a kallikrein binding protein described herein. In some embodiments, the plasma kallikrein binding protein binds the same epitope or competes for binding with a protein (e.g., epi-Kal2) and/or a small molecule (e.g., AEBSF) described herein and does not bind pre-plasma kallikrein.

In some embodiments, the protein described herein is selected from the group consisting of M162-A04, M160-G12, M142-H08, X63-G06, X101-A01 (also referred to herein as DX-2922), X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the plasma kallikrein binding protein competes with or binds the same epitope as X81-B01 and, e.g., does not bind pre-plasma kallikrein.

In some embodiments, the plasma kallikrein binding protein competes with or binds the same epitope as X67-D03 and, e.g., does not bind pre-plasma kallikrein.

In some embodiments, the plasma kallikrein binding protein competes with or binds to the same site as X101-A01 and, e.g., does not bind pre-plasma kallikrein.

In some embodiments, the plasma kallikrein binding protein competes with or binds to the same site as M162-A04 and, e.g., does not bind pre-plasma kallikrein.

In some embodiments, the plasma kallikrein binding protein competes with or binds to the same site as X63-G06 and, e.g., does not bind pre-plasma kallikrein.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In certain embodiments, the protein binds at or near the active site of the catalytic domain of plasma kallikrein, or a fragment thereof, or binds an epitope that overlaps with the active site of plasma kallikrein and, e.g., does not bind pre-plasma kallikrein.

In some embodiments, the protein binds to one or more amino acids that form the catalytic triad of plasma kallikrein: His434, Asp483, and/or Ser578 (numbering based on the human sequence) and, e.g., does not bind pre-plasma kallikrein.

In some embodiments, the protein binds to one or more amino acids of: Ser479, Tyr563, and/or Asp585 (numbering based on the human sequence) and, e.g., does not bind pre-plasma kallikrein.

In some embodiments, the plasma kallikrein binding protein binds one or more amino acids of: Arg551, Gln553, Tyr555, Thr558, and/or Arg560 (numbering based on the human kallikrein sequence). In other embodiments, the plasma kallikrein binding protein binds two, three, four or five (i.e., all) amino acids of: Arg551, Gln553, Tyr555, Thr558, and/or Arg560 (numbering based on the human sequence) and, e.g., does not bind pre-plasma kallikrein.

In some embodiments, the plasma kallikrein binding protein binds one or more amino acids of: S478, N481, S525, and K526 (numbering based on the human kallikrein sequence). In other embodiments, the plasma kallikrein binding protein binds two, three or four (i.e., all) amino acids of: S478, N481, S525, and K526 (numbering based on the human kallikrein sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 1, 0.5 or 0.2 nM.

In one embodiment, the HC and LC variable domain sequences are components of the same polypeptide chain.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In other embodiments, the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the plasma kallikrein binding protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

In some aspects, the disclosure features an isolated protein (e.g., antibody, e.g., human antibody) that binds the same epitope or competes for binding with a kallikrein binding protein described herein.

In some embodiments, the protein binds the same epitope or competes for binding with a protein (e.g., epi-Kal2) and/or a small molecule (e.g., AEBSF) described herein.

In some embodiments, the isolated protein comprises a heavy chain immunoglobulin variable domain sequence and a light chain immunoglobulin variable domain sequence, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the heavy chain immunoglobulin variable domain sequence comprises one, two, or three (e.g., three) CDR regions from the heavy chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

the light chain immunoglobulin variable domain sequence comprises one, two, or three (e.g., three) CDR regions from the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein inhibits plasma kallikrein (e.g., human plasma kallikrein and/or mouse plasma kallikrein).

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the one, two, or three (e.g., three) CDR regions from the heavy chain variable domain are from X63-G06 and/or the one, two, or three (e.g., three) CDR regions from the light chain variable domain are from X63-G06.

In some embodiments, the one, two, or three (e.g., three) CDR regions from the heavy chain variable domain are from M162-A04 and/or the one, two, or three (e.g., three) CDR regions from the light chain variable domain are from MJ162-A04.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain immunoglobulin variable domain sequence comprises the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

and/or the light chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

In some embodiments, the protein has an apparent inhibition constant ($K_{i,app}$) of less than 1000, 500, 100, 10, 1, 0.5 or 0.2 nM.

In some embodiments, the antibody does not bind prekallikrein (e.g., human prekallikrein and/or mouse prekallikrein), but binds to the active form of plasma kallikrein (e.g., human plasma kallikrein and/or mouse plasma kallikrein).

In a preferred embodiment, the protein is an antibody (e.g., a human antibody) having the light and heavy chains of antibodies selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the light chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

and one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the protein is an IgG, e.g., IgG1, IgG2, IgG3, or IgG4. The protein can be a soluble Fab (sFab).

In other embodiments, the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a pharmaceutical composition comprising a kallikrein binding protein described herein, e.g., including a pharmaceutically acceptable carrier. In some embodiments, the composition can be at least 10, 20, 30, 50, 75, 85, 90, 95, 98, 99, or 99.9% free of other protein species. In one embodiment, the pharmaceutical composition can be at least 10, 20, 30, 50, 75, 85, 90, 95, 98, 99, or 99.9% free of fragments of the binding protein that do not binding plasma kallikrein (e.g., human plasma kallikrein) or bind plasma kallikrein (e.g., human plasma kallikrein with a Ki, app of 5000 nM or greater.

In some aspects, the disclosure features a method of treating or preventing a plasma kallikrein associated disorder in a subject, the method comprising:

administering an isolated protein (e.g., antibody, e.g., human antibody) that binds plasma kallikrein (e.g., human plasma kallikrein and/or mouse plasma kallikrein) and, e.g., does not bind prekallikrein (e.g., human prekallikrein and/or mouse prekallikrein) to the subject, In some embodiments, the protein binds the same epitope or competes for binding with a protein (e.g., epi-Kal2) and/or a small molecule (e.g., AEBSF) described herein.

In some embodiments, the protein binds the same epitope or competes for binding with a kallikrein binding protein described herein.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting on ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. In some embodiments, the plasma kallikrein binding protein reduces abberent clotting associated with the contact activation system (i.e., intrinsic activation system) by at least 10% as measured by e.g., an APTT clotting assay. In other embodiments, the plasma kallikrein binding protein reduces abberent clotting associated with the contact activation system by at least 20%, at least 30%, at least 40%, at least 50%, at least 60%, at least 70%, at least 80%, at least 90%, at least 95%, at least 99%, or even 100% (i.e., no detectable abberent clotting).

In some embodiments, the plasma kallikrein binding protein is administered in combination with another treatment for the disorder.

In some embodiments, the protein described herein is selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the plasma kallikrein binding protein competes with or binds the same epitope as X81-B01.

In some embodiments, the plasma kallikrein binding protein competes with or binds the same epitope as X67-D03.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In certain embodiments, the protein binds at or near the active site of the catalytic domain of plasma kallikrein, or a fragment thereof, or binds an epitope that overlaps with the active site of plasma kallikrein.

In some embodiments, the protein binds to one or more amino acids that form the catalytic triad of plasma kallikrein: His434, Asp483, and/or Ser578 (numbering based on the human sequence).

In some embodiments, the protein binds to one or more amino acids of Ser479, Tyr563, and/or Asp585 (numbering based on the human sequence).

In other embodiments, the protein binds to one or more amino acids of Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 5, 1, 0.5, or 0.2 nM.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In other implementations the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the plasma kallikrein binding protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

A method of treating or preventing a plasma kallikrein associated disorder in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein (e.g., human plasma kallikrein and/or mouse plasma kallikrein).

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting of ventrical assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some embodiments, the protein is administered in combination with another treatment for the disorder.

In some embodiments, the protein is administered in combination with a second agent selected from the group consisting of ecallantide, a C1 esterase inhibitor, aprotinin, a bradykinin B2 receptor inhibitor (e.g., icatibant).

In some embodiments, the heavy chain immunoglobulin variable domain sequence comprises one, two, or three (e.g., three) CDR regions from the heavy chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain immunoglobulin variable domain sequence comprises one, two, or three (e.g., three) CDR regions from the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein inhibits plasma kallikrein.

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M160-G12, M142-H08×63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain immunoglobulin variable domain sequence comprises the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; and (g) a primate CDR or primate framework region.

In some embodiments, the protein has an apparent inhibition constant ($K_{i,app}$) of less than 1000, 500, 100, 10, 5, 1, 0.5 or 0.2 nM.

In some embodiments, the antibody does not bind prekallikrein (e.g., human prekallikrein), but binds to the active form of plasma kallikrein (e.g., human plasma kallikrein).

In a preferred embodiment, the protein is an antibody (e.g., a human antibody) having the light and heavy chains of antibodies selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the light chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 and one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the protein is an IgG, e.g., IgG1, IgG2, IgG3, or IgG4. The protein can be a soluble Fab (sFab).

In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a method of promoting wound healing in a subject, the method comprising:
administering an isolated protein (e.g., antibody, e.g., human antibody) that binds plasma kallikrein (e.g., human plasma kallikrein and/or mouse plasma kallikrein) and, e.g., does not bind prekallikrein (e.g., human prekallikrein and/or mouse prekallikrein) to the subject.

In some embodiments, the protein binds the same epitope or competes for binding with a kallikrein binding protein described herein. In some embodiments, the protein binds the same epitope or competes for binding with a protein (e.g., epi-Kal2) and/or a small molecule (e.g., AEBSF) described herein.

In some embodiments, the plasma kallikrein binding protein is administered in combination with another treatment for wound healing.

In some embodiments, the protein described herein is selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the plasma kallikrein binding protein competes with or binds the same epitope as X81-B01.

In some embodiments, the plasma kallikrein binding protein competes with or binds the same epitope as X67-D03.

In some embodiments, the plasma kallikrein binding protein does not bind prekallikrein (e.g., human prekallikrein), but binds to the active form of plasma kallikrein (e.g., human plasma kallikrein).

In certain embodiments, the protein binds at or near the active site of the catalytic domain of plasma kallikrein, or a fragment thereof, or binds an epitope that overlaps with the active site of plasma kallikrein.

In some embodiments, the protein binds to one or more amino acids that form the catalytic triad of plasma kallikrein: His434, Asp483, and/or Ser578 (numbering based on the human sequence). In other embodiments, the protein binds to one or more amino acids that form a region for substrate recognition: Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the protein binds to one or more amino acids of Ser479, Tyr563, and/or Asp585 (numbering based on the human sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 5, 1, 0.5 or 0.2 nM.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In other implementations the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH:: CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

In some aspects, the disclosure features a method promoting wound healing in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the protein is administered in combination with another treatment for wound healing.

In some embodiments, the heavy chain immunoglobulin variable domain sequence comprises one, two, or three (e.g., three) CDR regions from the heavy chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or
the light chain immunoglobulin variable domain sequence comprises one, two, or three (e.g., three) CDR regions from the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein inhibits plasma kallikrein.

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain immunoglobulin variable domain sequence comprises the light chain variable domain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04, and/or the light chain of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; and (g) a primate CDR or primate framework region.

In some embodiments, the protein has an apparent inhibition constant ($K_{i,app}$) of less than 1000, 500, 100, 5, 1, 0.5 or 0.2 nM.

In some embodiments, the antibody does not bind prekallikrein (e.g., human prekallikrein and/or murine prekallikrein), but binds to the active form of plasma kallikrein (e.g., human plasma kallikrein and/or murine plasma kallikrein).

In a preferred embodiment, the protein is an antibody (e.g., a human antibody) having the light and heavy chains of antibodies selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the light chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 and one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the protein is an IgG, e.g., IgG1, IgG2, IgG3, or IgG4. The protein can be a soluble Fab (sFab).

In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a method of treating or preventing rheumatoid arthritis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for rheumatoid arthritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing gout in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for gout.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing intestinal bowel disease in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for intestinal bowel disease.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing oral mucositis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for oral mucositis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing neuropathic pain in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for neuropathic pain.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing inflammatory pain in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for inflammatory pain.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing spinal stenosis-degenerative spine disease in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for spinal stenosis-degenerative spine disease.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing arterial or venous thrombosis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for arterial or venous thrombosis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing post operative ileus in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for post operative ileus.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing aortic aneurysm in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for aortic aneurysm.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing osteoarthritis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for osteoarthritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing vasculitis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for vasculitis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing head trauma or peri-tumor brain edema in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for head trauma or peri-tumor brain edema.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing sepsis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for sepsis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing acute middle cerebral artery (MCA) ischemic event (stroke) in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for acute middle cerebral artery (MCA) ischemic event (stroke).

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing restenosis (e.g., after angioplasty) in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for restenosis (e.g., after angioplasty).

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing systemic lupus erythematosis nephritis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for systemic lupus erythematosis nephritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing burn injury in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for burn injury.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of detecting plasma kallikrein in a sample, the method comprising: contacting the sample with a plasma kallikrein binding protein (e.g., a plasma kallikrein binding protein described herein); and detecting an interaction between the protein and the plasma kallikrein, if present.

In some embodiments, the protein includes a detectable label.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some aspects, the disclosure features a method of detecting plasma kallikrein in a subject, the method comprising: administering a plasma kallikrein binding protein (e.g., a plasma kallikrein binding protein described herein) to a subject; and detecting an interaction between the protein and the plasma kallikrein in the subject, if present. For example, the detecting comprises imaging the subject.

In some embodiments, the protein further includes a detectable label.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some aspects, the disclosure features a method of modulating plasma kallikrein activity, e.g., in a method of treating or preventing a plasma kallikrein associated disorder. The method includes: contacting plasma kallikrein with a plasma kallikrein binding protein (e.g., a plasma kallikrein binding protein described herein) (e.g., in a human subject), thereby modulating plasma kallikrein activity.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis/vasculitis, and burn injury.

In some embodiments, the plasma kallikrein binding protein reduces abberent clotting associated with the contact activation system (i.e., intrinsic activation system) by at least 10% as measured by e.g., an APTT clotting assay. In other embodiments, the plasma kallikrein binding protein reduces abberent clotting associated with the contact activation system by at least 20%, at least 30%, at least 40%, at least 50%, at least 60%, at least 70%, at least 80%, at least 90%, at least 95%, at least 99%, or even 100% (i.e., no detectable abberent clotting).

In some aspects, the disclosure features a method of treating a plasma kallikrein associated disorder, the method comprising administering, to a subject, a plasma kallikrein binding protein (e.g., a plasma kallikrein binding protein described herein) in an amount sufficient to treat a plasma kallikrein associated disorder in the subject. The method can further include providing to the subject a second therapy that is therapy for the plasma kallikrein associated disorder, e.g., as described herein.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis/vasculitis, and burn injury.

In some aspects, the disclosure features a method of imaging a subject. The method includes administering a plasma kallikrein binding protein (e.g., a plasma kallikrein binding protein described herein) to the subject, and e.g., detecting an interaction between the protein and the plasma kallikrein in the subject, if present.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some embodiments, the protein does not inhibit plasma kallikrein activity.

In some embodiments, the protein inhibits plasma kallikrein activity (e.g., human plasma kallikrein and/or murine plasma kallikrein).

In some embodiments, the plasma kallikrein binding protein may include a detectable label (e.g., a radionuclide or an MRI-detectable label).

In some embodiments, the subject has or is suspected of having a plasma kallikrein associated disorder. The method is useful, e.g., for diagnosis of a plasma kallikrein associated disorder.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some aspects, the disclosure features a method of imaging plasma kallikrein, e.g., in a subject or sample (e.g., biopsy sample). The method includes administering a plasma kallikrein binding protein (e.g., a plasma kallikrein binding protein described herein), e.g., to the subject or the sample, and detecting an interaction between the protein and the plasma kallikrein, if present.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some embodiments, the protein does not inhibit plasma kallikrein activity.

In some embodiments, the protein inhibits plasma kallikrein activity (e.g., human plasma kallikrein and/or murine plasma kallikrein).

In some embodiments, the plasma kallikrein binding protein may include a detectable label (e.g., a radionuclide or an MRI-detectable label).

In some embodiments, the subject has or is suspected of having a plasma kallikrein associated disorder. The method is useful, e.g., for diagnosis of a plasma kallikrein associated disorder.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In one aspect, the disclosure features the use of a plasma kallikrein binding protein described herein for the treatment of a disorder described herein, e.g., rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, or burn injury; or to promote wound healing.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In one aspect, the disclosure features the use of a plasma kallikrein binding protein described herein for the manufacture of a medicament for the treatment of a disorder described herein, e.g., rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, or burn injury; or for the manufacture of a medicament for wound healing.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

The details of one or more embodiments of the invention are set forth in the accompanying drawings and the description below. Other features, objects, and advantages of the invention will be apparent from the description and drawings, and from the claims.

The contents of all cited references including literature references, issued patents, published or non-published patent applications cited throughout this application as well as those listed below are hereby expressly incorporated by reference in their entireties. In case of conflict, the present application, including any definitions herein, will control.

BRIEF DESCRIPTION OF DRAWINGS

FIG. 4 depicts the alignment of the light chain DNA sequence of nongermlined (X63-G06) (SEQ ID NO:1991) and germlined, codon optimized (X81-B01) (SEQ ID NO:1992) versions of the same antibody discovered using ROLIC affinity maturation. Positions indicated with an asterisk (*) are conserved, whereas blank spaces correspond to bases changed in X81-B01 due to either codon optimization or germlining.

FIG. 5 depicts the alignment of the light chain amino acid sequence of nongermlined (X63-G06) (SEQ ID NO:1993) and germlined, codon optimized (X81-B01) (SEQ ID NO:1994) versions of the same antibody discovered using ROLIC affinity maturation. Positions indicated with an asterisk (*) are conserved, whereas blank spaces correspond to amino acids changed in X81-B01 due to germlining. A total of 11 amino acids differ between the nongermlined (X63-G06) and germlined, codon optimized antibody (X81-B01).

FIG. 6 depicts the alignment of the heavy chain DNA sequence of nongermlined (X63-G06) (SEQ ID NO:1996) and germlined, codon optimized (X81-B01) (SEQ ID NO:1995) versions of the same antibody discovered using ROLIC affinity maturation. Positions indicated with an asterisk (*) are conserved, whereas blank spaces correspond to DNA bases changed in X81-B01 due to codon optimization.

FIG. 7 depicts the alignment of the heavy chain amino acid sequence of nongermlined (X63-G06) (SEQ ID NO:1998) and germlined, codon optimized (X81-B01) (SEQ ID NO:1997) versions of the same antibody discovered using ROLIC affinity maturation. Positions indicated with an asterisk (*) are conserved. The two antibodies have the same amino acid sequence in the heavy chain.

FIGS. 10A-10C depict ClustalW alignment of pKal sequences from different species (SEQ ID NOs:1999-2006). Positions indicated by a "*" are conserved positions between, whereas positions indicated ":" indicate conservative substitutions between species. Positions indicated by a "." have nonconservative substitutions in some species. Stretches of amino acids indicated by the symbol "@" were shown to be highly solvent exposed by solvent accessible surface area calculation. Stretches of amino acids indicated by a "+" were identified as potential epitopes of antibodies listed in Table 12. Amino acids highlighted in grey were found by solvent accessible surface area calculation to be buried when complexed with a Kunitz domain active site inhibitor. The underlined positions are the amino acids that form the catalytic triad (His434, Asp483, and Ser578, numbering based on the human sequence).

DETAILED DESCRIPTION

Definitions

Figure 1:
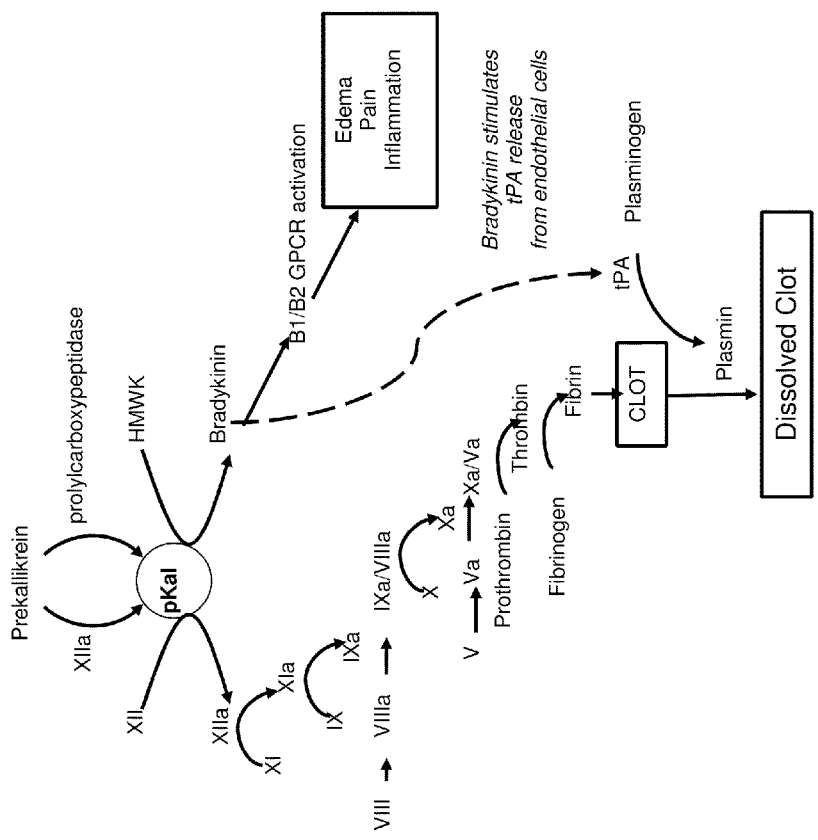
FIG. 1 is a schematic representation of the role of plasma kallikrein (pKal) in intrinsic coagulation pathway and inflammation.

For convenience, before further description of the present invention, certain terms employed in the specification, examples and appended claims are defined here. Other terms are defined as they appear in the specification.

The singular forms "a", "an", and "the" include plural references unless the context clearly dictates otherwise.

The term "agonist," as used herein, is meant to refer to an agent that mimics or up-regulates (e.g., potentiates or supplements) the bioactivity of a protein. An agonist can be a wild-type protein or derivative thereof having at least one bioactivity of the wild-type protein. An agonist can also be a compound which increases at least one bioactivity of a protein. An agonist can also be a compound which increases the interaction of a polypeptide with another molecule, e.g., a target peptide or nucleic acid.

"Antagonist" as used herein is meant to refer to an agent that downregulates (e.g., suppresses or inhibits) at least one bioactivity of a protein. An antagonist can be a compound which inhibits or decreases the interaction between a protein and another molecule, e.g., a target peptide or enzyme substrate. An antagonist can also be a compound which reduces the amount of expressed protein present.

The term "antibody" refers to a protein that includes at least one immunoglobulin variable domain (variable region) or immunoglobulin variable domain (variable region) sequence. For example, an antibody can include a heavy (H) chain variable region (abbreviated herein as VH or HV), and a light (L) chain variable region (abbreviated herein as VL or LV). In another example, an antibody includes two heavy (H) chain variable regions and two light (L) chain variable regions. The term "antibody" encompasses antigen-binding fragments of antibodies (e.g., single chain antibodies, Fab and sFab fragments, F(ab')$_2$, Fd fragments, Fv fragments, scFv, and domain antibodies (dAb) fragments (de Wildt et al., Eur J. Immunol. 1996; 26(3):629-39)) as well as complete antibodies. An antibody can have the structural features of IgA, IgG, IgE, IgD, IgM (as well as subtypes thereof). Antibodies may be from any source, but primate (human and non-human primate) and primatized are preferred.

The VH and VL regions can be further subdivided into regions of hypervariability, termed "complementarity determining regions" ("CDRs"), interspersed with regions that are more conserved, termed "framework regions" ("FRs"). The extent of the framework region and CDRs have been defined (see, Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917). Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

As used herein, an "immunoglobulin variable domain sequence" refers to an amino acid sequence which can form the structure of an immunoglobulin variable domain such that one or more CDR regions are positioned in a conformation suitable for an antigen binding site. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form an antigen binding site, e.g., a structure that preferentially interacts with plasma kallikrein.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and/or LC CDR3. Each of the light chain (LC) and/or heavy chain (HC) CDRs can be human. HC CDR3 can be human. One or more of the framework regions can be human, e.g., FR1, FR2, FR3, and/or FR4 of the HC and/or LC. For example, the Fc region can be human. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. In one embodiment, the framework (FR) residues of a selected Fab can be converted to the amino-acid type of the corresponding residue in the most similar primate germline gene, especially the human germline gene. One or more of the constant regions can be human or effectively human. For example, at least 70, 75, 80, 85, 90, 92, 95, 98, or 100% of an immunoglobulin variable domain, the constant region, the constant domains (CH1, CH2, CH3, and/or CL1), or the entire antibody can be human or effectively human.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the many immunoglobulin variable region genes. Full-length immunoglobulin "light chains" (about 25 KDa or about 214 amino acids) are encoded by a variable region gene at the NH2-terminus (about 110 amino acids) and a kappa or lambda constant region gene at the COOH-terminus. Full-length immunoglobulin "heavy chains" (about 50 KDa or about 446 amino acids), are similarly encoded by a variable region gene (about 116 amino acids) and one of the other aforementioned constant region genes, e.g., gamma (encoding about 330 amino acids). The length of human HC varies considerably because HC CDR3 varies from about 3 amino-acid residues to over 35 amino-acid residues.

The term "antigen-binding fragment" of a full length antibody refers to one or more fragments of a full-length antibody that retain the ability to specifically bind to a target of interest. Examples of binding fragments encompassed within the term "antigen-binding fragment" of a full length antibody and that retain functionality include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., U.S. Pat. Nos. 5,260,203, 4,946,778, and 4,881,175; Bird et al. (1988) Science 242:423-426; and Huston et al. (1988) Proc. Natl. Acad. Sci. USA 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refers to a preparation of antibodies or fragments thereof of single molecular composition, irrespective of how the antibody was generated.

Antibodies are "germlined" by reverting one or more non-germline amino acids in framework regions to corresponding germline amino acids of the antibody, so long as binding properties are substantially retained.

The inhibition constant (Ki) provides a measure of inhibitor potency; it is the concentration of inhibitor required to reduce enzyme activity by half and is not dependent on enzyme or substrate concentrations. The apparent Ki ($K_{i,app}$) is obtained at different substrate concentrations by measuring the inhibitory effect of different concentrations of inhibitor (e.g., inhibitory binding protein) on the extent of the reaction (e.g., enzyme activity); fitting the change in pseudo-first order rate constant as a function of inhibitor concentration to the Morrison equation (Equation 1) yields an estimate of the apparent Ki value. The Ki is obtained from the y-intercept extracted from a linear regression analysis of a plot of Ki,app versus substrate concentration.

$$v = v_o - v_o \left( \frac{(K_{i,app} + I + E) - \sqrt{(K_{i,app} + I + E)^2 - 4 \cdot I \cdot E}}{2 \cdot E} \right) \quad \text{Equation 1}$$

Where v=measured velocity; $v_0$=velocity in the absence of inhibitor; $K_{i,app}$=apparent inhibition constant; I=total inhibitor concentration; and E=total enzyme concentration.

As used herein, "binding affinity" refers to the apparent association constant or $K_A$. The $K_A$ is the reciprocal of the dissociation constant ($K_D$). A binding protein may, for example, have a binding affinity of at least $10^5$, $10^6$, $10^7$, $10^8$, $10^9$, $10^{10}$ and $10^{11}$ M$^{-1}$ for a particular target molecule, e.g., plasma kallikrein. Higher affinity binding of a binding protein to a first target relative to a second target can be indicated by a higher $K_A$ (or a smaller numerical value $K_D$) for binding the first target than the $K_A$ (or numerical value $K_D$) for binding the second target. In such cases, the binding protein has specificity for the first target (e.g., a protein in a first conformation or mimic thereof) relative to the second target (e.g., the same protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, 10,000 or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in HBS-P buffer (10 mM HEPES pH7.4, 150 mM NaCl, 0.005% (v/v) Surfactant P20). These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

$$[Bound] = N \cdot [Free]/((1/K_A) + [Free]).$$

It is not always necessary to make an exact determination of $K_A$, though, since sometimes it is sufficient to obtain a quantitative measurement of affinity, e.g., determined using a method such as ELISA or FACS analysis, is proportional to $K_A$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

The term "binding protein" refers to a protein that can interact with a target molecule. This term is used interchangeably with "ligand." A "plasma kallikrein binding protein" refers to a protein that can interact with (e.g., bind) plasma kallikrein, and includes, in particular, proteins that preferentially or specifically interact with and/or inhibit plasma kallikrein. A protein inhibits plasma kallikrein if it causes a decrease in the activity of plasma kallikrein as compared to the activity of plasma kallikrein in the absence of the protein and under the same conditions. In some embodiments, the plasma kallikrein binding protein is an antibody.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

It is possible for one or more framework and/or CDR amino acid residues of a binding protein to include one or more mutations (e.g., substitutions (e.g., conservative substitutions or substitutions of non-essential amino acids), insertions, or deletions) relative to a binding protein described herein. A plasma kallikrein binding protein may have mutations (e.g., substitutions (e.g., conservative substitutions or substitutions of non-essential amino acids), insertions, or deletions) (e.g., at least one, two, three, or four, and/or less than 15, 12, 10, 9, 8, 7, 6, 5, 4, 3, or 2 mutations) relative to a binding protein described herein, e.g., mutations which do not have a substantial effect on protein function. The mutations can be present in framework regions, CDRs, and/or constant regions. In some embodiments, the mutations are present in a framework region. In some embodiments, the mutations are present in a CDR. In some embodiments, the mutations are present in a constant region. Whether or not a particular substitution will be tolerated, i.e., will not adversely affect biological properties, such as binding activity, can be predicted, e.g., by evaluating whether the mutation is conservative or by the method of Bowie, et al. (1990) Science 247:1306-1310.

Motif sequences for biopolymers can include positions which can be varied amino acids. For example, the symbol "X" in such a context generally refers to any amino acid (e.g., any of the twenty natural amino acids) unless otherwise specified, e.g., to refer to any non-cysteine amino acid. Other allowed amino acids can also be indicated for example, using parentheses and slashes. For example, "(A/W/F/N/Q)" means that alanine, tryptophan, phenylalanine, asparagine, and glutamine are allowed at that particular position.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue, glycosyl group, phosphate group, sulfate group, or other molecular feature.

A first binding protein (e.g., antibody) "binds to the same epitope" as a second binding protein (e.g., antibody) if the first binding protein binds to the same site on a target compound that the second binding protein binds, or binds to a site that overlaps (e.g., 50%, 60%, 70%, 80%, 90%, or 100% overlap, e.g., in terms of amino acid sequence or other molecular feature (e.g., glycosyl group, phosphate group, or sulfate group)) with the site that the second binding protein binds.

A first binding protein (e.g., antibody) "competes for binding" with a second binding protein (e.g., antibody) if the binding of the first binding protein to its epitope decreases (e.g., by 10%, 20%, 30%, 40%, 50%, 60%, 70%, 80%, 90%, 100%, or more) the amount of the second binding protein that binds to its epitope. The competition can be direct (e.g., the first binding protein binds to an epitope that is the same as, or overlaps with, the epitope bound by the second binding protein), or indirect (e.g., the binding of the first binding protein to its epitope causes a steric change in the target compound that decreases the ability of the second binding protein to bind to its epitope).

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 90%, 92%, 95%, 97%, 98%, or 100% of the length of the reference sequence. For example, the reference sequence may be the length of the immunoglobulin variable domain sequence.

A "humanized" immunoglobulin variable region is an immunoglobulin variable region that is modified to include a sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

As used herein, the term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6. Aqueous and non-aqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The disclosure includes nucleic acids that hybridize with low, medium, high, or very high stringency to a nucleic acid described herein or to a complement thereof, e.g., nucleic acids encoding a binding protein described herein.

The nucleic acids can be the same length or within 30, 20, or 10% of the length of the reference nucleic acid. The nucleic acid can correspond to a region encoding an immunoglobulin variable domain sequence described herein.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interest is at least 5, 10, 25, 50, 75, 80, 90, 92, 95, 98, or 99% pure on a weight-weight basis.

An "isolated" protein refers to a protein that is removed from at least 90% of at least one component of a natural sample from which the isolated protein can be obtained. Proteins can be "of at least" a certain degree of purity if the species or population of species of interest is at least 5, 10, 25, 50, 75, 80, 90, 92, 95, 98, or 99% pure on a weight-weight basis.

The term "modulator" refers to a polypeptide, nucleic acid, macromolecule, complex, molecule, small molecule, compound, species or the like (naturally-occurring or non-naturally-occurring), or an extract made from biological materials such as bacteria, plants, fungi, or animal cells or tissues, that may be capable of causing modulation. Modulators may be evaluated for potential activity as inhibitors or activators (directly or indirectly) of a functional property, biological activity or process, or combination of them, (e.g., agonist, partial antagonist, partial agonist, inverse agonist, antagonist, anti-microbial agents, inhibitors of microbial infection or proliferation, and the like) by inclusion in assays. In such assays, many modulators may be screened at one time. The activity of a modulator may be known, unknown or partially known.

A "non-essential" amino acid residue is a residue that can be altered from the wild-type sequence of the binding agent, e.g., the antibody, without abolishing or more preferably, without substantially altering a biological activity, whereas changing an "essential" amino acid residue results in a substantial loss of activity.

A "patient," "subject" or "host" (these terms are used interchangeably) to be treated by the subject method may mean either a human or non-human animal.

The terms "prekallikrein" and "preplasma kallikrein" are used interchangeably herein and refer to the zymogen form of active plasma kallikrein, which is also known as prekallikrein.

The term "preventing" or to "prevent" a disease in a subject refers to subjecting the subject to a pharmaceutical treatment, e.g., the administration of a drug, such that at least one symptom of the disease is prevented, that is, administered prior to clinical manifestation of the unwanted condition (e.g., disease or other unwanted state of the host animal) so that it protects the host against developing the unwanted condition. "Preventing" a disease may also be referred to as "prophylaxis" or "prophylactic treatment."

As used herein, the term "substantially identical" (or "substantially homologous") is used herein to refer to a first amino acid or nucleic acid sequence that contains a sufficient number of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50%, at least 25%, or at least 10% of the affinity relative to the same antigen.

Sequences similar or homologous (e.g., at least about 85% sequence identity) to the sequences disclosed herein are also part of this application. In some embodiments, the sequence identity can be about 85%, 90%, 91%, 92%, 93%, 94%, 95%, 96%, 97%, 98%, 99% or higher. In some embodiments, a plasma kallikrein binding protein can have about 85%, 90%, 91%, 92%, 93%, 94%, 95%, 96%, 97%, 98%, 99% or higher sequence identity to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC framework regions (e.g., HC and/or LC FR 1, 2, 3, and/or 4) to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC CDRs (e.g., HC and/or LC CDR1, 2, and/or 3) to a binding protein described herein. In some embodiments, a plasma kallikrein binding protein can have about 85%, 90%, 91%, 92%, 93%, 94%, 95%, 96%, 97%, 98%, 99% or higher sequence identity in the constant region (e.g., CH1, CH2, CH3, and/or CL1) to a binding protein described herein.

In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05 or 0.02. Particular binding proteins may show a difference, e.g., in specificity or binding that are statistically significant (e.g., P value <0.05 or 0.02). The terms "induce", "inhibit", "potentiate", "elevate", "increase", "decrease" or the like, e.g., which denote distinguishable qualitative or quantitative differences between two states, may refer to a difference, e.g., a statistically significant difference, between the two states.

A "therapeutically effective dosage" preferably modulates a measurable parameter, e.g., plasma kallikrein activity, by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., rheumatoid arthritis or oral mucositis. Alternatively, this property of a composition can be evaluated by examining the ability of the compound to modulate a parameter in vitro.

"Treating" a disease (or condition) in a subject or "treating" a subject having a disease refers to subjecting the subject to a pharmaceutical treatment, e.g., the administration of a drug, such that at least one symptom of the disease is cured, alleviated or decreased.

The term "preventing" a disease in a subject refers to subjecting the subject to a pharmaceutical treatment, e.g., the administration of a drug, such that at least one symptom of the disease is prevented, that is, administered prior to clinical manifestation of the unwanted condition (e.g., disease or other unwanted state of the host animal) so that it protects the host against developing the unwanted condition. "Preventing" a disease may also be referred to as "prophylaxis" or "prophylactic treatment."

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

As used herein the term "DX-2922" as used inchangeably with the term "X101-A01". Other variants of this antibody are described below.

| Antibody Identification | Description |
|---|---|
| X63-G06 | Non-germlined Fab discovered using ROLIC, same HC but different LC as M160-G12 |
| X81-B01 | Germlined IgG produced in HEK 293T cells |
| X101-A01 | Germlined IgG produced in CHO cells, same HC and LC sequence as X81-B01 |
| DX-2922 | Alternate nomenclature for X101-A01 |

Plasma Kallikrein Binding Proteins

Plasma kallikrein binding proteins can be full-length (e.g., an IgG (e.g., an IgG1, IgG2, IgG3, IgG4), IgM, IgA (e.g., IgA1, IgA2), IgD, and IgE) or can include only an antigen-binding fragment (e.g., a Fab, F(ab')2 or scFv fragment. The binding protein can include two heavy chain immunoglobulins and two light chain immunoglobulins, or can be a single chain antibody. Plasma kallikrein binding proteins can be recombinant proteins such as humanized, CDR grafted, chimeric, deimmunized, or in vitro generated antibodies, and may optionally include constant regions derived from human germline immunoglobulin sequences. In one embodiment, the plasma kallikrein binding protein is a monoclonal antibody.

In one aspect, the disclosure features a protein (e.g., an isolated protein) that binds to plasma kallikrein (e.g., human plasma kallikrein and/or murine kallikrein) and includes at least one immunoglobulin variable region. For example, the protein includes a heavy chain (HC) immunoglobulin variable domain sequence and/or a light chain (LC) immunoglobulin variable domain sequence. In one embodiment, the protein binds to and inhibits plasma kallikrein, e.g., human plasma kallikrein and/or murine kallikrein.

The protein can include one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

The plasma kallikrein binding protein may be an isolated protein (e.g., at least 70, 80, 90, 95, or 99% free of other proteins). In some embodiments, the plasma kallikrein binding protein, or composition thereof, is isolated from antibody cleavage fragments (e.g., cleaved DX-2922) that are inactive or partially active (e.g., bind plasma kallikrein with a Ki, app of 5000 nM or greater) compared to the plasma kallikrein binding protein. For example, the plasma kallikrein binding protein is at least 70% free of such antibody cleavage fragments; in other embodiments the binding protein is at least 80%, at least 90%, at least 95%, at least 99% or even 100% free from antibody cleavage fragments that are inactive or partially active.

The plasma kallikrein binding protein may additionally inhibit plasma kallikrein, e.g., human plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine kallikrein).

In certain embodiments, the protein binds at or near the active site of the catalytic domain of plasma kallikrein, or a fragment thereof, or binds an epitope that overlaps with the active site of plasma kallikrein.

In some aspects, the protein binds the same epitope or competes for binding with a protein described herein.

In some embodiments, the protein competes with or binds the same epitope as M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the protein binds to (e.g., positions on plasma kallikrein corresponding to) CLIPS peptide C1, C2, C3, C4, C5, C6, or C7, or more than one of these peptides, e.g., the protein binds to C5 and C6. CLIPS peptides C1-C7 are peptides in plasma kallikrein identified by CLIPS epitope mapping (see FIGS. 9 and 10A-10C). C1 corresponds to positions 55-67 of the catalytic domain, C2 to positions 81-94, C3 to positions 101-108, C4 to positions 137-151, C5 to positions 162-178, C6 to positions 186-197, and C7 to positions 214-217 of plasma kallikrein.

Figure 9:
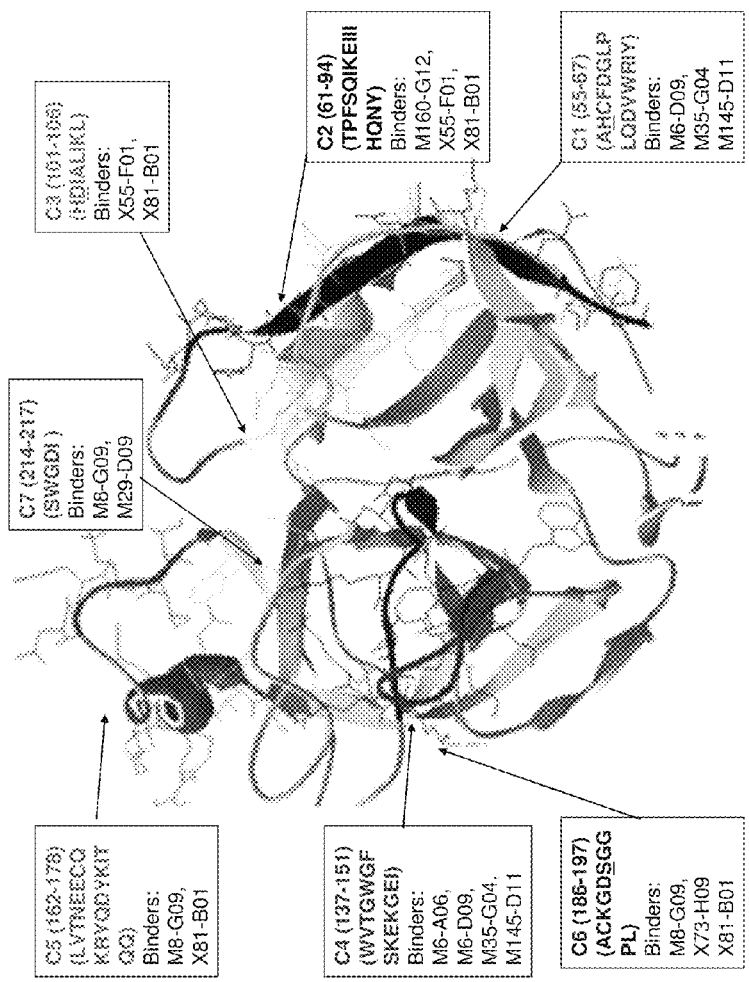
FIG. 9 depicts the results of CLIPS epitope mapping for antibodies listed in Table 12.

In some embodiments, the protein binds to an epitope shown in FIG. 9.

In some embodiments, the protein binds to one or more amino acids that form the catalytic triad of plasma kallikrein: His434, Asp483, and/or Ser578 (numbering based on the human sequence).

In some embodiments, the protein binds one or more amino acids of: Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the protein binds to one or more amino acids of Ser479, Tyr563, and/or Asp585 (numbering based on the human sequence).

The active site cleft of plasma kallikrein contains three amino acids that form the catalytic triad (His434, Asp483, and Ser578) and result in enzymatic hydrolysis of bound substrate (catalytic triad residues are underlined in FIG. 10). The peptides selected for the CLIPS epitope mapping analysis were determined to be surface accessible and either form or surround the vicinity of the active site. Peptide C1 contains the active site histidine 434. Peptide C3 contains the active site aspartate 483. Peptide C6 contains the active site serine 578. It is possible for an antibody to bind multiple surface exposed amino acids that are discontinuous in amino acid sequence. For example, by CLIPs analysis, X81-B01 appears to bind the C2, C3, C5 and the C6 peptides.

In some embodiments, the protein binds to an epitope that includes one or more amino acids from CLIPS peptide C1, peptide C2, peptide C3, peptide C4, peptide C5, peptide C6, or peptide C7.

In some embodiments, the protein binds to an epitope that includes amino acids from at least 2 different CLIPS peptides, e.g., from at least two of peptide C1, peptide C2, peptide C3, peptide C4, peptide C5, peptide C6, or peptide C7.

The protein can bind to plasma kallikrein, e.g., human plasma kallikrein, with a binding affinity of at least $10^5$, $10^6$, $10^7$, $10^8$, $10^9$, $10^{10}$ and $10^{11}$ M$^{-1}$. In one embodiment, the protein binds to human plasma kallikrein with a $K_{off}$ slower than $1 \times 10^{-3}$, $5 \times 10^{-4}$ s$^{-1}$, or $1 \times 10^{-4}$ s$^{-1}$. In one embodiment, the protein binds to human plasma kallikrein with a $K_{on}$ faster than $1 \times 10^2$, $1 \times 10^3$, or $5 \times 10^3$ M$^{-1}$ s$^{-1}$. In one embodiment, the protein binds to plasma kallikrein, but does not bind to tissue kallikrein and/or plasma prekallikrein (e.g., the protein binds to tissue kallikrein and/or plasma prekallikrein less effectively (e.g., 5-, 10-, 50-, 100-, or 1000-fold less or not at all, e.g., as compared to a negative control) than it binds to plasma kallikrein.

In one embodiment, the protein inhibits human plasma kallikrein activity, e.g., with a Ki of less than $10^{-5}$, $10^{-6}$, $10^{-7}$, $10^{-8}$, $10^{-9}$, and $10^{-10}$ M. The protein can have, for example, an IC$_{50}$ of less than 100 nM, 10 nM, 1, 0.5, or 0.2 nM. For example, the protein may modulate plasma kallikrein activity, as well as the production of Factor XIIa (e.g., from Factor XII) and/or bradykinin (e.g., from high-molecular-weight kininogen (HMWK)). The protein may inhibit plasma kallikrein activity, and/or the production of Factor XIIa (e.g., from Factor XII) and/or bradykinin (e.g., from high-molecular-weight kininogen (HMWK)). The affinity of the protein for human plasma kallikrein can be characterized by a $K_D$ of less than 100 nm, less than 10 nM, less than 5 nM, less than 1 nM, less than 0.5 nM. In one embodiment, the protein inhibits plasma kallikrein, but does not inhibit tissue kallikrein (e.g., the protein inhibits tissue kallikrein less effectively (e.g., 5-, 10-, 50-, 100-, or 1000-fold less or not at all, e.g., as compared to a negative control) than it inhibits plasma kallikrein.

In some embodiments, the protein has an apparent inhibition constant ($K_{i,app}$) of less than 1000, 500, 100, 5, 1, 0.5 or 0.2 nM.

Plasma kallikrein binding proteins may be antibodies. Plasma kallikrein binding antibodies may have their HC and LC variable domain sequences included in a single polypeptide (e.g., scFv), or on different polypeptides (e.g., IgG or Fab).

In a preferred embodiment, the protein is an antibody (e.g., a human antibody) having the light and heavy chains of antibodies selected from the group consisting of M162-A04, M160-G12, M142-H08×63-G06, X101-A01, X81-B01, X67-D03, X67-G04, DX-2922, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having the light chain of an antibody selected from the group consisting of: M162-A04, M160-G12, M142-H08×63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs and one or more (e.g., 1, 2, or 3) light chain CDRs selected from the corresponding CDRs of the group of light chains consisting of M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In one embodiment, the HC and LC variable domain sequences are components of the same polypeptide chain. In another, the HC and LC variable domain sequences are components of different polypeptide chains. For example, the protein is an IgG, e.g., IgG1, IgG2, IgG3, or IgG4. The protein can be a soluble Fab. In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions, or framework regions at least 85, 88, 89, 90, 91, 92, 93, 94, 95, 96, 97, 98, 99% identical to human framework regions. In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions, or framework regions at least 85, 88, 89, 90, 91, 92, 93, 94, 95, 96, 97, 98, 99% identical to primate framework regions. In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In some embodiments, the affinity of the primate antibody for human plasma kallikrein is characterized by a $K_D$ of less than 1000, 500, 100, 10, 5, 1, 0.5 nM, e.g., less than 10 nM, less than 1 nM, or less than 0.5 nM.

In certain embodiments, the protein includes no sequences from mice or rabbits (e.g., is not a murine or rabbit antibody).

In some aspects, the disclosure provides the use of proteins (e.g., binding proteins, e.g., antibodies) (e.g., the proteins described herein) that bind to plasma kallikrein (e.g., human plasma kallikrein) and include at least one immunoglobin variable region in methods for treating (or preventing) a plasma kallikrein associated disorder or condition. For example, the plasma kallikrein binding protein includes a heavy chain (HC) immunoglobulin variable domain sequence and a light chain (LC) immunoglobulin variable domain sequence. A number of exemplary plasma kallikrein binding proteins are described herein.

The plasma kallikrein binding protein may be an isolated protein (e.g., at least 70, 80, 90, 95, or 99% free of other proteins).

The plasma kallikrein binding protein may additionally inhibit plasma kallikrein, e.g., human plasma kallikrein and/or murine plasma kallikrein. In some embodiments, it may be preferred to have an plasma kallikrein binding protein bind to both human and murine plasma kallikrein, as these antibodies can be tested for efficacy in a mouse model.

Plasma Kallikrein

Exemplary plasma kallikrein sequences against which plasma kallikrein binding proteins may be developed can include human, mouse, or rat plasma kallikrein amino acid sequences, a sequence that is 80%, 85%, 90%, 95%, 96%, 97%, 98%, or 99% identical to one of these sequences, or a fragment thereof, e.g., of a sequence provided below.

The sequence of human plasma kallikrein that was used in selections and subsequent screening is shown below (accession number NP_000883.2). The human plasma kallikrein (86 kDa) that was used was purified from human plasma and activated with factor XIIa by a commercial vendor. Factor XIIa activates prekallikrein by cleaving the polypeptide sequence at a single site (between Arg371-Ile372, cleavage site marked by "/" in the sequence below) to generate active plasma kallikrein, which then consists of two disulfide linked polypeptides; a heavy chain of approximately 52 kDa and a catalytic domain of approximately 34 kDa [Colman and Schmaier, (1997) "Contact System: A Vascular Biology Modulator With Anticoagulant, Profibrinolytic, Antiadhesive, and Proinflammatory Attributes" Blood, 90, 3819-3843]

```
                                              (SEQ ID NO: 1)
GCLTQLYENAFFRGGDVASMYTPNAQYCQMRCTFHPRCLLFSFLPASS

INDMEKRFGCFLKDSVTGTLPKVHRTGAVSGHSLKQCGHQISACHRDIY

KGVDMRGVNFNVSKVSSVEECQKRCTSNIRCQFFSYATQTFHKAE

YRNNCLLKYSPGGTPTAIKVLSNVESGFSLKPCALSEIGCHMNIFQHLAF

SDVDVARVLTPDAFVCRTICTYHPNCLFFTFYTNVWKIESQRNVCLLKTS

ESGTPSSSTPQENTISGYSLLTCKRTLPEPCHSKIYPGVDFGGEELNVTF

VKGVNVCQETCTKMIRCQFFTYSLLPEDCKEEKCKCFLRLSMDGSPTRI

AYGTQGSSGYSLRLCNTGDNSVCTTKTSTR/IVGGTNSSWGEWPWQVS

LQVKLTAQRHLCGGSLIGHQWVLTAAHCFDGLPLQDVWRIYSGILNLSDI

TKDTPFSQIKEIIIHQNYKVSEGNHDIALIKLQAPLNYTEFQKPICLPS

KGDTSTIYTNCWVTGWGFSKEKGEIQNILQKVNIPLVTNEECQKRYQ

DYKITQRMVCAGYKEGGKDACKGDSGGPLVCKHNGMWRLVGITSWGEG

CARREQPGVYTKVAEYMDWILEKTQSSDGKAQMQSPA
```

The human, mouse, and rat prekallikrein amino acid sequences, and the mRNA sequences encoding the same, are illustrated below. The sequences of prekallikrein are the same as plasma kallikrein, except that active plasma kallikrein (pkal) has the single polypeptide chain cleaved at a single position (indicated by the "l") to generate two chains. The sequences provided below are full sequences that include signal sequences. On secretion from the expressing cell, it is expected that the signal sequences are removed.

Human plasma kallikrein (ACCESSION: NP_000883.2)
>gi|78191798|ref|NP_000883.2|plasma kallikrein B1 precursor [Homo sapiens]
MILFKQATYFISLFATVSCGCLTQLYENAFFRGGDVASMYTPNAQYCQMRCTFHPRCLLFSLPASSIND
MEKRFGCFLKDSVTGTLPKVHRTGAVSGHSLKQCGHQISACHRDIYKGVDMRGVNFNVSKVSSVEECQKR
CTSNIRCQFFSYATQTFHKAEYRNNCLLKYSPGGTPTAIKVLSNVESGFSLKPCALSEIGCHMNIFQHLA
FSDVDVARVLTPDAFVCRTICTYHPNCLFFTFYTNVWKIESQRNVCLLKTSESGTPSSSTPQENTISGYS
LLTCKRTLPEPCHSKIYPGVDFGGEELNVTFVKGVNVCQETCTKMIRCQFFTYSLLPEDCKEEKCKCFLR
LSMDGSPTRIAYGTQGSSGYSLRLCNTGDNSVCTTKTSTRIVGGTNSSWGEWPWQVSLQVKLTAQRHLCG
GSLIGHQWVLTAAHCFDGLPLQDVWRIYSGILNLSDITKDTPFSQIKEIIIHQNYKVSEGNHDIALIKLQ
APLNYTEFQKPICLPSKGDTSTIYTNCWVTGWGFSKEKGEIQNILQKVNIPLVTNEECQKRYQDYKITQR
MVCAGYKEGGKDACKGDSGGPLVCKHNGMWRLVGITSWGEGCARREQPGVYTKVAEYMDWILEKTQSSDG
KAQMQSPA (SEQ ID NO: 2)

Human plasma kallikrein mRNA (ACCESSION: NM_000892)
>gi|78191797|ref|NM_000892.3|Homo sapiens kallikrein B, plasma
(Fletcher factor) 1 (KLKB1), mRNA
AGAACAGCTTGAAGACCGTTCATTTTTAAGTGACAAGAGACTCACCTCCAAGAAGCAATTGTGTTTTCAG
AATGATTTTATTCAAGCAAGCAACTTATTTCATTTCCTTGTTTGCTACAGTTTCCTGTGGATGTCTGACT
CAACTCTATGAAAACGCCTTCTTCAGAGGTGGGGATGTAGCTTCCATGTACACCCCAAATGCCCAATACT
GCCAGATGAGGTGCACATTCCACCCAAGGTGTTTGCTATTCAGTTTTCTTCCAGCAAGTTCAATCAATGA
CATGGAGAAAAGGTTTGGTTGCTTCTTGAAAGATAGTGTTACAGGAACCCTGCCAAAAGTACATCGAACA
GGTGCAGTTTCTGGACATTCCTTGAAGCAATGTGGTCATCAAATAAGTGCTTGCCATCGAGACATTTATA
AAGGAGTTGATATGAGAGGAGTCAATTTTAATGTGTCTAAGGTTAGCAGTGTTGAAGAATGCCAAAAAG
GTGCACCAGTAACATTCGCTGCCAGTTTTTTTCATATGCCACGCAAACATTTCACAAGGCAGAGTACCGG
AACAATTGCCTATTAAAGTACAGTCCCGGAGGAACACCTACCGCTATAAAGGTGCTGAGTAACGTGGAAT
CTGGATTCTCACTGAAGCCCTGTGCCCTTTCAGAAATTGGTTGCCACATGAACATCTTCCAGCATCTTGC
GTTCTCAGATGTGGATGTTGCCAGGGTTCTCACTCCAGATGCTTTTGTGTGTCGGACCATCTGCACCTAT
CACCCCAACTGCCTCTTCTTTACATTCTATACAAATGTATGGAAAATCGAGTCACAAAGAAATGTTTGTC
TTCTTAAAACATCTGAAAGTGGCACACCAAGTTCCTCTACTCCTCAAGAAAACACCATATCTGGATATAG
CCTTTTAACCTGCAAAAGAACTTTACCTGAACCCTGCCATTCTAAAATTTACCCGGGAGTTGACTTTGGA
GGAGAAGAATTGAATGTGACTTTTGTTAAAGGAGTGAATGTTTGCCAAGAGACTTGCACAAAGATGATTC
GCTGTCAGTTTTTCACTTATTCTTTACTCCCAGAAGACTGTAAGGAAGAGAAGTGTAAGTGTTTCTTAAG
ATTATCTATGGATGGTTCTCCAACTAGGATTGCGTATGGGACACAAGGGAGCTCTGGTTACTCTTTGAGA
TTGTGTAACACTGGGGACAACTCTGTCTGCACAACAAAAACAAGCACACGCATTGTTGGAGGAACAAACT
CTTCTTGGGGAGAGTGGCCCTGGCAGGTGAGCCTGCAGGTGAAGCTGACAGCTCAGAGGCACCTGTGTGG
AGGGTCACTCATAGGACACCAGTGGGTCCTCACTGCTGCCCACTGCTTTGATGGGCTTCCCCTGCAGGAT
GTTTGGCGCATCTATAGTGGCATTTTAAATCTGTCAGACATTACAAAAGATACACCTTTCTCACAAATAA
AAGAGATTATTATTCACCAAAACTATAAAGTCTCAGAAGGGAATCATGATATCGCCTTGATAAAACTCCA
GGCTCCTTTGAATTACACTGAATTCCAAAAACCAATATGCCTACCTTCCAAAGGTGACACAAGCACAATT
TATACCAACTGTTGGGTAACCGGATGGGGCTTCTCGAAGGAGAAAGGTGAAATCCAAATATTCTACAAA
AGGTAAATATTCCTTTGGTAACAAATGAAGAATGCCAGAAAAGATATCAAGATTATAAAATAACCCAACG
GATGGTCTGTGCTGGCTATAAAGAAGGGGGAAAAGATGCTTGTAAGGGAGATTCAGGTGGTCCCTTAGTT
TGCAAACACAATGGAATGTGGCGTTTGGTGGGCATCACCAGCTGGGGTGAAGGCTGTGCCCGCAGGGAGC
AACCTGGTGTCTACACCAAAGTCGCTGAGTACATGGACTGGATTTTAGAGAAAACACAGAGCAGTGATGG -continued

```
AAAAGCTCAGATGCAGTCACCAGCATGAGAAGCAGTCCAGAGTCTAGGCAATTTTTACAACCTGAGTTCA

AGTCAAATTCTGAGCCTGGGGGGTCCTCATCTGCAAAGCATGGAGAGTGGCATCTTCTTTGCATCCTAAG

GACGAAAAACACAGTGCACTCAGAGCTGCTGAGGACAATGTCTGGCTGAAGCCCGCTTTCAGCACGCCGT

AACCAGGGGCTGACAATGCGAGGTCGCAACTGAGATCTCCATGACTGTGTGTTGTGAAATAAAATGGTGA

AAGATCAAAAAA (SEQ ID NO: 3)
```

Mouse plasma kallikrein (ACCESSION: NP_032481.1)
>gi|6680584|ref|NP_032481.1|kallikrein B, plasma 1 [*Mus musculus*]
```
MILFNRVGYFVSLFATVSCGCMTQLYKNTFFRGGDLAAIYTPDAQYCQKMCTFHPRCLLFSFLAVTPPKE

TNKRFGCFMKESITGTLPRIHRTGAISGHSLKQCGHQISACHRDIYKGLDMRGSNFNISKTDNIEECQKL

CTNNFHCQFFTYATSAFYRPEYRKKCLLKHSASGTPTSIKSADNLVSGFSLKSCALSEIGCPMDIFQHSA

FADLNVSQVITPDAFVCRTICTFHPNCLFFTFYTNEWETESQRNVCFLKTSKSGRPSPPIPQENAISGYS

LLTCRKTRPEPCHSKIYSGVDFEGEELNVTFVQGADVCQETCTKTIRCQFFIYSLLPQDCKEEGCKCSLR

LSTDGSPTRITYGMQGSSGYSLRLCKLVDSPDCTTKINARIVGGTNASLGEWPWQVSLQVKLVSQTHLCG

GSIIGRQWVLTAAHCFDGIPYPDVWRIYGGILSLSEITKETPSSRIKELIIHQEYKVSEGNYDIALIKLQ

TPLNYTEFQKPICLPSKADTNTIYTNCWVTGWGYTKEQGETQNILQKATIPLVPNEECQKKYRDYVINKQ

MICAGYKEGGTDACKGDSGGPLVCKHSGRWQLVGITSWGEGCGRKDQPGVYTKVSEYMDWILEKTQSSDV

RALETSSA (SEQ ID NO: 4)
```

Mouse plasma kallikrein mRNA (ACCESSION: NM_008455.2)
>gi|236465804|ref|NM_008455.2|*Mus musculus* kallikrein B, plasma 1 (Klkb1), mRNA
```
AGACCGCCCTCGGTGCCATATTCAGAGGGCTTGAAGACCATCTTCATGTGAAGACTCCCTCTCCTCCAGA

ACCACAACGTGACCATCCTTCCAGGATGATTTTATTCAACCGAGTGGGTTATTTTGTTTCCTTGTTTGCT

ACCGTCTCCTGTGGGTGTATGACTCAACTGTATAAAAATACCTTCTTCAGAGGTGGGGATCTAGCTGCCA

TCTACACCCCAGATGCCCAGTACTGTCAGAAGATGTGCACTTTTCACCCCAGGTGCCTGCTGTTCAGCTT

TCTCGCCGTGACTCCACCCAAAGAGACAAATAAACGGTTTGGTTGCTTCATGAAAGAGAGCATTACAGGG

ACTTTGCCAAGAATACACCGGACAGGGGCCATTTCTGGTCATTCTTTAAAGCAGTGTGGCCATCAAATAA

GTGCTTGCCACCGAGACATATACAAAGGACTTGATATGAGAGGGTCCAACTTTAATATCTCTAAGACCGA

CAATATTGAAGAATGCCAGAAACTGTGCACAAATAATTTTCACTGCCAATTTTTCACATATGCTACAAGT

GCATTTTACAGACCAGAGTACCGGAAGAAGTGCCTGCTGAAGCACAGTGCAAGCGGAACACCCACCAGCA

TAAAGTCAGCGGACAACCTGGTGTCTGGATTCTCACTGAAGTCCTGTGCGCTTTCGGAGATAGGTTGCCC

CATGGATATTTTCCAGCACTCTGCCTTTGCAGACCTGAATGTAAGCCAGGTCATCACCCCCGATGCCTTT

GTGTGTCGCACCATCTGCACCTTCCATCCCAACTGCCTTTTCTTCACGTTCTACACGAATGAATGGGAGA

CAGAATCACAGAGAAATGTTTGTTTTCTTAAGACGTCTAAAAGTGGAAGACCAAGTCCCCCTATTCCTCA

AGAAAACGCTATATCTGGATATAGTCTCCTCACCTGCAGAAAAACTCGCCCTGAACCCTGCCATTCCAAA

ATTTACTCTGGAGTTGACTTTGAAGGGGAAGAACTGAATGTGACCTTCGTGCAAGGAGCAGATGTCTGCC

AAGAGACTTGTACAAAGACAATCCGCTGCCAGTTTTTTATTTACTCCTTACTCCCCAAGACTGCAAGGA

GGAGGGGTGTAAATGTTCCTTAAGGTTATCCACAGATGGCTCCCCAACTAGGATCACCTATGGCATGCAG

GGGAGCTCCGGTTATTCTCTGAGATTGTGTAAACTTGTGACAGCCCTGACTGTACAACAAAATAAATG

CACGTATTGTGGGAGGAACAAACGCTTCTTTAGGGGAGTGGCCATGGCAGGTCAGCCTGCAAGTGAAGCT

GGTATCTCAGACCCATTTGTGTGGAGGGTCCATCATTGGTCGCCAATGGGTACTGACAGCTGCCCATTGC

TTTGATGGAATTCCCTATCCAGATGTGTGGCGTATATATGGCGGAATTCTTAGTCTGTCCGAGATTACGA

AAGAAACGCCTTCCTCGAGAATAAAGGAGCTTATTATTCATCAGGAATACAAAGTCTCAGAAGGCAATTA

TGATATTGCCTTAATAAAGCTTCAGACGCCCCTGAATTATACTGAATTCCAAAAACCAATATGCCTGCCT
```

-continued

```
TCCAAAGCTGACACAAATACAATTTATACCAACTGTTGGGTGACTGGATGGGGCTACACGAAGGAACAAG

GTGAAACGCAAAATATTCTACAAAAGGCTACTATTCCTTTGGTACCAAATGAAGAATGCCAGAAAAATA

CAGAGATTATGTTATAAACAAGCAGATGATCTGTGCTGGCTACAAAGAAGGCGGAACAGACGCTTGTAAG

GGAGATTCCGGTGGCCCCTTAGTCTGTAAACACAGTGGACGGTGGCAGTTGGTGGGTATCACCAGCTGGG

GTGAAGGCTGCGCCCGCAAGGACCAACCAGGAGTCTACACCAAAGTTTCTGAGTACATGGACTGGATATT

GGAGAAGACACAGAGCAGTGATGTAAGAGCTCTGGAGACATCTTCAGCCTGAGGAGGCTGGGTACCAAGG

AGGAAGAACCCAGCTGGCTTTACCACCTGCCCTCAAGGCAAACTAGAGCTCCAGGATTCTCGGCTGTAAA

ATGTTGATAATGGTGTCTACCTCACATCCGTATCATTGGATTGAAAATTCAAGTGTAGATATAGTTGCTG

AAGACAGCGTTTTGCTCAAGTGTGTTTCCTGCCTTGAGTCACAGGAGCTCCAATGGGAGCATTACAAAGA

TCACCAAGCTTGTTAGGAAAGAGAATGATCAAAGGGTTTTATTAGGTAATGAAATGTCTAGATGTGATGC

AATTGAAAAAAGACCCCAGATTCTAGCACAGTCCTTGGGACCATTCTCATGTAACTGTTGACTCTGGAC

CTCAGCAGATCTCAGAGTTACCTGTCCACTTCTGACATTTGTTTATTAGAGCCTGATGCTATTCTTTCAA

GTGGAGCAAAAAAAAAAAAAAA (SEQ ID NO: 5)
```

Rat plasma kallikrein (ACCESSION: NP_036857.2)
>gi|162138905|ref|NP_036857.2|kallikrein B, plasma 1 [*Rattus norvegicus*]

```
MILFKQVGYFVSLFATVSCGCLSQLYANTFFRGGDLAAIYTPDAQHCQKMCTFHPRCLLFSFLAVSPTKE

TDKRFGCFMKESITGTLPRIHRTGAISGHSLKQCGHQLSACHQDIYEGLDMRGSNFNISKTDSIEECQKL

CTNNIHCQFFTYATKAFHRPEYRKSCLLKRSSSGTPTSIKPVDNLVSGFSLKSCALSEIGCPMDIFQHFA

FADLNVSHVVTPDAFVCRTVCTFHPNCLFFTFYTNEWETESQRNVCFLKTSKSGRPSPPIIQENAVSGYS

LFTCRKARPEPCHFKIYSGVAFEGEELNATFVQGADACQETCTKTIRCQFFTYSLLPQDCKAEGCKCSLR

LSTDGSPTRITYEAQGSSGYSLRLCKVVESSDCTTKINARIVGGTNSSLGEWPWQVSLQVKLVSQNHMCG

GSIIGRQWILTAAHCFDGIPYPDVWRIYGGILNLSEITNKTPFSSIKELIIHQKYKMSEGSYDIALIKLQ

TPLNYTEFQKPICLPSKADTNTIYTNCWVTGWGYTKERGETQNILQKATIPLVPNEECQKKYRDYVITKQ

MICAGYKEGGIDACKGDSGGPLVCKHSGRWQLVGITSWGEGCARKEQPGVYTKVAEYIDWILEKIQSSKE

RALETSPA
```

Rat plasma kallikrein mRNA (ACCESSION: NM_012725)
>gi|162138904|ref|NM_012725.2|*Rattus norvegicus* kallikrein B, plasma 1 (Klkb1), mRNA

```
TGAAGACTAGCTTCATGTGAAGACTCCTTCTCCTCCAGCAGCACAAAGCAACCATCCTTCCAGGATGATT

TTATTCAAACAAGTGGGTTATTTTGTTTCCTTGTTCGCTACAGTTTCCTGTGGGTGTCTGTCACAACTGT

ATGCAAATACCTTCTTCAGAGGTGGGGATCTGGCTGCCATCTACACCCCGGATGCCCAGCACTGTCAGAA

GATGTGCACGTTTCACCCCAGGTGCCTGCTCTTCAGCTTCCTTGCCGTGAGTCCAACCAAGGAGACAGAT

AAAAGGTTTGGGTGCTTCATGAAAGAGAGCATTACAGGGACTTTGCCAAGAATACACCGGACAGGGCCA

TTTCTGGTCATTCTTTAAAACAGTGTGGCCATCAATTAAGTGCTTGCCACCAAGACATATACGAAGGACT

GGATATGAGAGGGTCCAACTTTAATATATCTAAGACCGACAGTATTGAAGAATGCCAGAAACTGTGCACA

AATAATATTCACTGCCAATTTTTCACATATGCTACAAAAGCATTTCACAGACCAGAGTACAGGAAGAGTT

GCCTGCTGAAGCGCAGTTCAAGTGGAACGCCCACCAGTATAAAGCCAGTGGACAACCTGGTGTCTGGATT

CTCACTGAAGTCCTGTGCTCTCTCAGAGATCGGTTGCCCCATGGATATTTTCCAGCACTTTGCCTTTGCA

GACCTGAATGTAAGCCATGTCGTCACCCCCGATGCCTTCGTGTGTCGCACCGTTTGCACCTTCCATCCCA

ACTGCCTCTTCTTCACATTCTACACGAATGAGTGGGAGACGGAATCACAGAGGAATGTTTGTTTTCTTAA

GACATCTAAAAGTGGAAGACCAAGTCCCCCTATTATTCAAGAAAATGCTGTATCTGGATACAGTCTCTTC

ACCTGCAGAAAAGCTCGCCCTGAACCCTGCCATTTCAAGATTTACTCTGGAGTTGCCTTCGAAGGGGAAG
```

```
AACTGAACGCGACCTTCGTGCAGGGAGCAGATGCGTGCCAAGAGACTTGTACAAAGACCATCCGCTGTCA

GTTTTTTACTTACTCATTGCTTCCCCAAGACTGCAAGGCAGAGGGGTGTAAATGTTCCTTAAGGTTATCC

ACGGATGGCTCTCCAACTAGGATCACCTATGAGGCACAGGGGAGCTCTGGTTATTCTCTGAGACTGTGTA

AAGTTGTGGAGAGCTCTGACTGTACGACAAAAATAAATGCACGTATTGTGGGAGGAACAAACTCTTCTTT

AGGAGAGTGGCCATGGCAGGTCAGCCTGCAAGTAAAGTTGGTTTCTCAGAATCATATGTGTGGAGGGTCC

ATCATTGGACGCCAATGGATACTGACGGCTGCCCATTGCTTTGATGGGATTCCCTATCCAGACGTGTGGC

GTATATATGGCGGGATTCTTAATCTGTCAGAGATTACAAACAAAACGCCTTTCTCAAGTATAAAGGAGCT

TATTATTCATCAGAAATACAAAATGTCAGAAGGCAGTTACGATATTGCCTTAATAAAGCTTCAGACACCG

TTGAATTATACTGAATTCCAAAAACCAATATGCCTGCCTTCCAAAGCTGACACAAATACAATTTATACCA

ACTGCTGGGTGACTGGATGGGGCTACACAAAGGAACGAGGTGAGACCCAAAATATTCTACAAAAGGCAAC

TATTCCCTTGGTACCAAATGAAGAATGCCAGAAAAAATATAGAGATTATGTTATAACCAAGCAGATGATC

TGTGCTGGCTACAAAGAAGGTGGAATAGATGCTTGTAAGGGAGATTCCGGTGGCCCCTTAGTTTGCAAAC

ATAGTGGAAGGTGGCAGTTGGTGGGTATCACCAGCTGGGGCGAAGGCTGTGCCCGCAAGGAGCAACCAGG

AGTCTACACCAAAGTTGCTGAGTACATTGACTGGATATTGGAGAAGATACAGAGCAGCAAGGAAAGAGCT

CTGGAGACATCTCCAGCATGAGGAGGCTGGGTACTGATGGGGAAGAGCCCAGCTGGCACCAGCTTTACCA

CCTGCCCTCAAGTCCTACTAGAGCTCCAGAGTTCTCTTCTGCAAAATGTCGATAGTGGTGTCTACCTCGC

ATCCTTACCATAGGATTAAAAGTCCAAATGTAGACACAGTTGCTAAAGACAGCGCCATGCTCAAGCGTGC

TTCCTGCCTTGAGCAACAGGAACGCCAATGAGAACTATCCAAAGATTACCAAGCCTGTTTGGAAATAAAA

TGGTCAAAGGATTTTTATTAGGTAGTGAAATTAGGTAGTTGTCCTTGGAACCATTCTCATGTAACTGTTG

ACTCTGGACCTCAGCAGATCACAGTTACCTTCTGTCCACTTCTGACATTTGTGTACTGGAACCTGATGCT

GTTCTTCCACTTGGAGCAAAGAACTGAGAAACCTGGTTCTATCCATTGGGAAAAAGAGATCTTTGTAACA

TTTCCTTTACAATAAAAAGATGTTCTACTTGGACTTGAAAAAAAAAAAAAAAAAAAAAAAAAAA
(SEQ ID NO: 7)
```

Display Libraries

A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a sFab. In one exemplary implementation, a display library can be used to identify proteins that bind to plasma kallikrein. In a selection, the polypeptide component of each member of the library is probed with plasma kallikrein (or fragment thereof) and if the polypeptide component binds to the plasma kallikrein, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component and purification of the polypeptide component for detailed characterization.

A variety of formats can be used for display libraries. Examples include the following.

Phage Display:

The protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) Science 228:1315-1317; WO 92/18619; WO 91/17271; WO 92/20791; WO 92/15679; WO 93/01288; WO 92/01047; WO 92/09690; WO 90/02809; de Haard et al. (1999) J. Biol. Chem. 274:18218-30; Hoogenboom et al. (1998) Immunotechnology 4:1-20; Hoogenboom et al. (2000) Immunol Today 2:371-8 and Hoet et al. (2005) Nat. Biotechnol. 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other Display Formats.

Other display formats include cell based display (see, e.g., WO 03/029456), protein-nucleic acid fusions (see, e.g., U.S. Pat. No. 6,207,446), ribosome display (See, e.g., Mattheakis et al. (1994) Proc. Natl. Acad. Sci. USA 91:9022 and Hanes et al. (2000) Nat. Biotechnol. 18:1287-92; Hanes et al. (2000) Methods Enzymol. 328:404-30; and Schaffitzel et al. (1999) J Immunol Methods. 231(1-2):119-35), and *E. coli* periplasmic display (J Immunol Methods. 2005 Nov. 22; PMID: 16337958).

Scaffolds.

Scaffolds useful for display include: antibodies (e.g., Fab fragments, single chain Fv molecules (scFv), single domain antibodies, camelid antibodies, and camelized antibodies); T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin and heat shock proteins; intracellular signaling domains (such as SH2 and SH3 domains); linear and constrained peptides; and linear peptide substrates. Display libraries can include synthetic and/or natural diversity. See, e.g., U.S. 2004-0005709.

Display technology can also be used to obtain binding proteins (e.g., antibodies) that bind particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection.

In one preferred embodiment, display library technology is used in an iterative mode. A first display library is used to identify one or more binding proteins for a target. These identified binding proteins are then varied using a mutagenesis method to form a second display library. Higher affinity binding proteins are then selected from the second library, e.g., by using higher stringency or more competitive binding and washing conditions.

In some implementations, the mutagenesis is targeted to regions at the binding interface. If, for example, the identified binding proteins are antibodies, then mutagenesis can be directed to the CDR regions of the heavy or light chains as described herein. Further, mutagenesis can be directed to framework regions near or adjacent to the CDRs. In the case of antibodies, mutagenesis can also be limited to one or a few of the CDRs, e.g., to make precise step-wise improvements. Exemplary mutagenesis techniques include: error-prone PCR, recombination, DNA shuffling, site-directed mutagenesis and cassette mutagenesis.

In one example of iterative selection, the methods described herein are used to first identify a protein from a display library that binds plasma kallikrein, with at least a minimal binding specificity for a target or a minimal activity, e.g., an equilibrium dissociation constant for binding of less than 0.5 nM, 1 nM, 10 nM, or 100 nM. The nucleic acid sequences encoding the initial identified proteins are used as a template nucleic acid for the introduction of variations, e.g., to identify a second protein that has enhanced properties (e.g., binding affinity, kinetics, or stability) relative to the initial protein.

Off-Rate Selection.

Since a slow dissociation rate can be predictive of high affinity, particularly with respect to interactions between polypeptides and their targets, the methods described herein can be used to isolate binding proteins with a desired (e.g., reduced) kinetic dissociation rate for a binding interaction to a target.

To select for slow dissociating binding proteins from a display library, the library is contacted to an immobilized target. The immobilized target is then washed with a first solution that removes non-specifically or weakly bound biomolecules. Then the bound binding proteins are eluted with a second solution that includes a saturating amount of free target or a target specific high-affinity competing monoclonal antibody, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting or Screening for Specificity.

The display library screening methods described herein can include a selection or screening process that discards display library members that bind to a non-target molecule. Examples of non-target molecules include streptavidin on magnetic beads, blocking agents such as bovine serum albumin, non-fat bovine milk, soy protein, any capturing or target immobilizing monoclonal antibody, or non-transfected cells which do not express the target.

In one implementation, a so-called "negative selection" step is used to discriminate between the target and related non-target molecule and a related, but distinct non-target molecule. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target as well as for cross species reactivity to related targets or subunits of the target (e.g., plasma kallikrein) and also under different condition such as pH 6 or pH 7.5. The non-target and target binding data are compared (e.g., using a computer and software) to identify library members that specifically bind to the target.

Other Exemplary Expression Libraries

Other types of collections of proteins (e.g., expression libraries) can be used to identify proteins with a particular property (e.g., ability to bind plasma kallikrein), including, e.g., protein arrays of antibodies (see, e.g., De Wildt et al. (2000) Nat. Biotechnol. 18:989-994), lambda gt11 libraries, two-hybrid libraries and so forth.

Exemplary Libraries

It is possible to immunize a non-human primate and recover primate antibody genes that can be displayed on phage (see below). From such a library, one can select antibodies that bind the antigen used in immunization. See, for example, Vaccine. (2003) 22(2):257-67 or Immunogenetics. (2005) 57(10):730-8. Thus one could obtain primate antibodies that bind and inhibit plasma kallikrein by immunizing a chimpanzee or macaque and using a variety of means to select or screen for primate antibodies that bind and inhibit plasma kallikrein. One can also make chimeras of primatized Fabs with human constant regions, see Curr Opin Mol. Ther. (2004) 6(6):675-83. "PRIMATIZED antibodies, genetically engineered from cynomolgus macaque monkey and human components, are structurally indistinguishable from human antibodies. They may, therefore, be less likely to cause adverse reactions in humans, making them potentially suited for long-term, chronic treatment" *Curr Opin Investig Drugs*. (2001) 2(5):635-8.

One exemplary type of library presents a diverse pool of polypeptides, each of which includes an immunoglobulin domain, e.g., an immunoglobulin variable domain. Of interest are display libraries where the members of the library include primate or "primatized" (e.g., such as human, non-human primate or "humanized") immunoglobin domains (e.g., immunoglobin variable domains) or chimeric primatized Fabs with human constant regions. Human or humanized immunoglobin domain libraries may be used to identify human or "humanized" antibodies that, for example, recognize human antigens. Because the constant and framework regions of the antibody are human, these antibodies may avoid themselves being recognized and targeted as antigens when administered to humans. The constant regions may also be optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay, 1988, Ann. Rev. Immunol. 6:381-405). The display library can display the antibody as a Fab fragment (e.g., using two polypeptide chains) or a single chain Fv (e.g., using a single polypeptide chain). Other formats can also be used.

As in the case of the Fab and other formats, the displayed antibody can include one or more constant regions as part of a light and/or heavy chain. In one embodiment, each chain includes one constant region, e.g., as in the case of a Fab. In other embodiments, additional constant regions are displayed.

Antibody libraries can be constructed by a number of processes (see, e.g., de Haard et al., 1999, J. Biol. Chem. 274: 18218-30; Hoogenboom et al., 1998, Immunotechnology 4:1-20; Hoogenboom et al., 2000, Immunol. Today 21:371-378, and Hoet et al. (2005) Nat. Biotechnol. 23(3):344-8. Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and/or FR4, referring to such regions of either and both of heavy and light chain variable domains. For example, the variation(s) may be introduced into all three CDRs of a given variable domain, or into CDR1 and CDR2, e.g., of a heavy chain variable domain. Any combination is feasible. In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al., 2000, J. Mol. Biol. 296:57-86 describe a method for constructing CDR encoding oligonucleotides using trinucleotide synthesis and a template with engineered restriction sites for accepting the oligonucleotides.

In another process, an animal (e.g., a rodent) is immunized with plasma kallikrein. The animal is optionally boosted with the antigen to further stimulate the response. Then spleen cells are isolated from the animal, and nucleic acid encoding VH and/or VL domains is amplified and cloned for expression in the display library.

In yet another process, antibody libraries are constructed from nucleic acid amplified from naïve germline immunoglobulin genes. The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains can be obtained from the immune cells of, e.g., a primate (e.g., a human), mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cells are cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin, or pokeweed mitogen.

In another embodiment, the cells are isolated from a subject that has a disease of condition described herein, e.g., a plasma kallikrein associated disease or condition.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al., 2001, J. Immunol. 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by degrading uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al., 1999, J. Biol. Chem. 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Secondary Screening Methods

After selecting candidate library members that bind to a target, each candidate library member can be further analyzed, e.g., to further characterize its binding properties for the target, e.g., plasma kallikrein. Each candidate library member can be subjected to one or more secondary screening assays. The assay can be for a binding property, a catalytic property, an inhibitory property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use a display library member directly, a recombinant polypeptide produced from the nucleic acid encoding the selected polypeptide, or a synthetic peptide synthesized based on the sequence of the selected polypeptide. In the case of selected Fabs, the Fabs can be evaluated or can be modified and produced as intact IgG proteins. Exemplary assays for binding properties include the following.

ELISA.

Binding proteins can be evaluated using an ELISA assay. For example, each protein is contacted to a microtitre plate whose bottom surface has been coated with the target, e.g., a limiting amount of the target. The plate is washed with buffer to remove non-specifically bound polypeptides. Then the amount of the binding protein bound to the target on the plate is determined by probing the plate with an antibody that can recognize the binding protein, e.g., a tag or constant portion of the binding protein. The antibody is linked to a detection system (e.g., an enzyme such as alkaline phosphatase or horse radish peroxidase (HRP) which produces a colorimetric product when appropriate substrates are provided).

Homogeneous Binding Assays.

The ability of a binding protein described herein to bind a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means, e.g., using a fluorimeter. By titrating the amount of the first or second binding molecule, a binding curve can be generated to estimate the equilibrium binding constant.

Another example of a homogenous assay is ALPHAS-CREEN™ (Packard Bioscience, Meriden Conn.). ALPHAS-CREEN™ uses two labeled beads. One bead generates singlet oxygen when excited by a laser. The other bead generates a light signal when singlet oxygen diffuses from the first bead and collides with it. The signal is only generated when the two beads are in proximity. One bead can be attached to the display library member, the other to the target. Signals are measured to determine the extent of binding.

Surface Plasmon Resonance (SPR).

The interaction of binding protein and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether, 1988, Surface Plasmons Springer Verlag; Sjolander and Urbaniczky, 1991, Anal. Chem. 63:2338-2345; Szabo et al., 1995, Curr. Opin. Struct. Biol. 5:699-705 and on-line resources provide by BIAcore International AB (Uppsala, Sweden).

Information from SPR can be used to provide an accurate and quantitative measure of the equilibrium dissociation constant ($K_D$), and kinetic parameters, including $K_{on}$ and $K_{off}$, for the binding of a binding protein to a target. Such data can be used to compare different biomolecules. For example, selected proteins from an expression library can be compared to identify proteins that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by x-ray crystallography or NMR). As a result, an understanding of the physical interaction between the protein and its target can be formulated and used to guide other design processes.

Cellular Assays.

Binding proteins can be screened for ability to bind to cells which transiently or stably express and display the target of interest on the cell surface. For example, plasma kallikrein binding proteins can be fluorescently labeled and binding to plasma kallikrein in the presence of absence of antagonistic antibody can be detected by a change in fluorescence intensity using flow cytometry e.g., a FACS machine.

Other Exemplary Methods for Obtaining Plasma Kallikrein Binding Proteins

In addition to the use of display libraries, other methods can be used to obtain a plasma kallikrein binding protein (e.g., antibody). For example, plasma kallikrein protein or a fragment thereof can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci.

Using the hybridoma technology, antigen-specific monoclonal antibodies (Mabs) derived from the genes with the desired specificity may be produced and selected. See, e.g., XENOMOUSE™, Green et al., 1994, *Nat. Gen.* 7:13-21; U.S. 2003-0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies (UK Patent Application GB 2188638A, filed on Mar. 26, 1987; U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762. Those methods include isolating, manipulating, and expressing the nucleic acid sequences that encode all or part of immunoglobulin Fv variable regions from at least one of a heavy or light chain. Numerous sources of such nucleic acid are available. For example, nucleic acids may be obtained from a hybridoma producing an antibody against a predetermined target, as described above. The recombinant DNA encoding the humanized antibody, or fragment thereof, can then be cloned into an appropriate expression vector.

Reducing Immunogenicity of Plasma Kallikrein Binding Proteins

Immunoglobin plasma kallikrein binding proteins (e.g., IgG or Fab plasma kallikrein binding proteins) may be modified to reduce immunogenicity. Reduced immunogenicity is desirable in plasma kallikrein binding proteins intended for use as therapeutics, as it reduces the chance that the subject will develop an immune response against the therapeutic molecule. Techniques useful for reducing immunogenicity of plasma kallikrein binding proteins include deletion/modification of potential human T cell epitopes and "germlining" of sequences outside of the CDRs (e.g., framework and Fc).

A plasma kallikrein-binding antibody may be modified by specific deletion of human T cell epitopes or "deimmunization," e.g., by the methods disclosed in WO 98/52976 and WO 00/34317. Briefly, the heavy and light chain variable regions of an antibody are analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al., 1992, J. Mol. Biol. 227:776-798; Cook, G. P. et al., 1995, Immunol. Today Vol. 16 (5): 237-242; Chothia, D. et al., 1992, J. Mol. Bio. 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding $V_H$ and $V_L$ can be constructed by mutagenesis or other synthetic methods (e.g., de novo synthesis, cassette replacement, and so forth). Mutagenized variable sequence can, optionally, be fused to a human constant region, e.g., human IgG1 or κ constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify any antibody, e.g., an antibody that includes a non-human sequence, e.g., a synthetic antibody, a murine antibody other non-human monoclonal antibody, or an antibody isolated from a display library.

Plasma kallikrein binding antibodies are "germlined" by reverting one or more non-germline amino acids in framework regions to corresponding germline amino acids of the antibody, so long as binding properties are substantially retained. Similar methods can also be used in the constant region, e.g., in constant immunoglobulin domains.

Antibodies that bind to plasma kallikrein, e.g., an antibody described herein, may be modified in order to make the variable regions of the antibody more similar to one or more germline sequences. For example, an antibody can include one, two, three, or more amino acid substitutions, e.g., in a framework, CDR, or constant region, to make it more similar to a reference germline sequence. One exemplary germlining method can include identifying one or more germline sequences that are similar (e.g., most similar in a particular database) to the sequence of the isolated antibody. Mutations (at the amino acid level) are then made in the isolated antibody, either incrementally or in combination with other mutations. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a framework and/or constant region. For example, a germline framework and/or constant region residue can be from a germline sequence that is similar (e.g., most similar) to the non-variable region being modified. After mutagenesis, activity (e.g., binding or other functional activity) of the antibody can be evaluated to determine if the germline residue or residues are tolerated (i.e., do not abrogate activity). Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may include using two germline sequences that separately contribute to the amino-terminal portion and the carboxy-terminal portion of the sequence. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at least 30, 50, 60, 70, 80, 90 or 100% of the FR regions identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, or 99.5% identical to a germline sequence in a region outside the CDRs (e.g., framework regions). Further, an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity as measured by $K_A$) can be within a factor or 100, 10, 5, 2, 0.5, 0.1, and 0.001 of the original antibody.

Germline sequences of human immunoglobin genes have been determined and are available from a number of sources, including the INTERNATIONAL IMMUNOGENETICS INFORMATION SYSTEM® (IMGT), and the V BASE directory (compiled by Tomlinson, I. A. et al. MRC Centre for Protein Engineering, Cambridge, UK).

Exemplary germline reference sequences for $V_{kappa}$ include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al., 1995, EMBO J. 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al., 1992, J. Mol. Biol. 227:799-817; Tomlinson et al., 1992, J. Mol. Biol. 227:776-798); and Tomlinson et al., 1995, EMBO J. 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Protein Production

Standard recombinant nucleic acid methods can be used to express a protein that binds to plasma kallikrein. Generally, a nucleic acid sequence encoding the protein is cloned into a nucleic acid expression vector. Of course, if the protein includes multiple polypeptide chains, each chain can be cloned into an expression vector, e.g., the same or different vectors, that are expressed in the same or different cells.

Antibody Production.

Some antibodies, e.g., Fabs, can be produced in bacterial cells, e.g., *E. coli* cells (see e.g., Nadkarni, A. et al., 2007 Protein Expr Purif 52(1):219-29). For example, if the Fab is encoded by sequences in a phage display vector that includes a suppressible stop codon between the display entity and a bacteriophage protein (or fragment thereof), the vector nucleic acid can be transferred into a bacterial cell that cannot suppress a stop codon. In this case, the Fab is not fused to the gene III protein and is secreted into the periplasm and/or media.

Antibodies can also be produced in eukaryotic cells. In one embodiment, the antibodies (e.g., scFv's) are expressed in a yeast cell such as *Pichia* (see, e.g., Powers et al., 2001, J. Immunol. Methods. 251:123-35; Schoonooghe S. et al., 2009 BMC Biotechnol. 9:70; Abdel-Salam, H A. et al., 2001 Appl Microbiol Biotechnol 56(1-2):157-64; Takahashi K. et al., 2000 Biosci Biotechnol Biochem 64(10):2138-44; Edqvist, J. et al., 1991 J Biotechnol 20(3):291-300), *Hanseula*, or *Saccharomyces*. One of skill in the art can optimize antibody production in yeast by optimizing, for example, oxygen conditions (see e.g., Baumann K., et al. 2010 BMC Syst. Biol. 4:141), osmolarity (see e.g., Dragosits, M. et al., 2010 BMC Genomics 11:207), temperature (see e.g., Dragosits, M. et al., 2009 J Proteome Res. 8(3):1380-92), fermentation conditions (see e.g., Ning, D. et al. 2005 J. Biochem. and Mol. Biol. 38(3): 294-299), strain of yeast (see e.g., Kozyr, A V et al. 2004 Mol Biol (Mosk) 38(6):1067-75; Horwitz, A H. et al., 1988 Proc Natl Acad Sci USA 85(22):8678-82; Bowdish, K. et al. 1991 J Biol Chem 266(18):11901-8), overexpression of proteins to enhance antibody production (see e.g., Gasser, B. et al., 2006 Biotechol. Bioeng. 94(2):353-61), level of acidity of the culture (see e.g., Kobayashi H., et al., 1997 FEMS Microbiol Lett 152(2):235-42), concentrations of substrates and/or ions (see e.g., Ko J H. et al., 2996 Appl Biochem Biotechnol 60(1):41-8). In addition, yeast systems can be used to produce antibodies with an extended half-life (see e.g., Smith, B J. et al. 2001 Bioconjug Chem 12(5):750-756), In one preferred embodiment, antibodies are produced in mammalian cells. Preferred mammalian host cells for expressing the clone antibodies or antigen-binding fragments thereof include Chinese Hamster Ovary (CHO cells) (including dhfr-CHO cells, described in Urlaub and Chasin, 1980, Proc. Natl. Acad. Sci. USA 77:4216-4220, used with a DHFR selectable marker, e.g., as described in Kaufman and Sharp, 1982, Mol. Biol. 159:601 621), lymphocytic cell lines, e.g., NS0 myeloma cells and SP2 cells, COS cells, HEK293T cells (J. Immunol. Methods (2004) 289(1-2):65-80), and a cell from a transgenic animal, e.g., a transgenic mammal. For example, the cell is a mammary epithelial cell.

In some embodiments, plasma kallikrein binding proteins are produced in a plant or cell-free based system (see e.g., Galeffi, P., et al., 2006 J Transl Med 4:39).

In addition to the nucleic acid sequence encoding the diversified immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, a recombinant expression vector encoding both the antibody heavy chain and the antibody light chain is introduced into dhfr⁻ CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

For antibodies that include an Fc domain, the antibody production system may produce antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcg receptors and complement C1q (Burton and Woof, 1992, Adv. Immunol. 51:1-84; Jefferis et al., 1998, Immunol. Rev. 163:59-76). In one embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

Characterization of Plasma Kallikrein Binding Proteins $IC_{50}$ (Inhibitory Concentration 50%) and $EC_{50}$ (Effective Concentration 50%).

Within a series or group of binding proteins, those having lower $IC_{50}$ or $EC_{50}$ values are considered more potent inhibitors of plasma kallikrein than those binding proteins having higher $IC_{50}$ or $EC_{50}$ values. Exemplary binding proteins have an $IC_{50}$ value of less than 800 nM, 400 nM, 100 nM, 25 nM, 5 nM, or 1 nM, e.g., as measured in an in vitro assay for inhibition of plasma kallikrein activity when the plasma kallikrein is at 2 pM.

Plasma kallikrein binding proteins may also be characterized with reference to the activity of Factor XII and HMWK (high-molecular-weight kininogen) signaling events, e.g., the production of Factor XIIa and/or bradykinin.

The binding proteins can also be evaluated for selectivity toward plasma kallikrein. For example, a plasma kallikrein binding protein can be assayed for its potency toward plasma kallikrein and a panel of kallikreins and an $IC_{50}$ value or $EC_{50}$ value can be determined for each kallikrein. In one embodiment, a compound that demonstrates a low $IC_{50}$ value or $EC_{50}$ value for the plasma kallikrein, and a higher $IC_{50}$ value or $EC_{50}$ value, e.g., at least 2-, 5-, or 10-fold higher, for another kallikrein within the test panel is considered to be selective toward plasma kallikrein.

A pharmacokinetics study in rat, mice, or monkey can be performed with plasma kallikrein binding proteins for determining plasma kallikrein half-life in the serum. Likewise, the effect of the binding protein can be assessed in vivo, e.g., in an animal model for a disease (e.g., carrageenin-induced edema in rat hind paw (Winter et al. Proc Soc Exp Biol Med. 1962; 111:544-7)), for use as a therapeutic, for example, to treat a disease or condition described herein, e.g., a plasma kallikrein associated disorder.

Pharmaceutical Compositions

Proteins (e.g., binding proteins) that bind to plasma kallikrein (e.g., human plasma kallikrein and/or murine plasma kallikrein) and, e.g., include at least one immunoglobin variable region can be used in methods for treating (or preventing) a plasma kallikrein associated disease or condition. The binding proteins can be present in a composition, e.g., a pharmaceutically acceptable composition or pharmaceutical composition, which includes a plasma kallikrein-binding protein, e.g., an antibody molecule or other polypeptide or peptide identified as binding to plasma kallikrein, as described herein. The plasma kallikrein binding protein can be formulated together with a pharmaceutically acceptable carrier. Pharmaceutical compositions include therapeutic compositions and diagnostic compositions, e.g., compositions that include labeled plasma kallikrein binding proteins for in vivo imaging, and compositions that include labeled plasma kallikrein binding proteins for treating (or preventing) a plasma kallikrein associated disease.

A pharmaceutically acceptable carrier includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal, or epidermal administration (e.g., by injection or infusion), although carriers suitable for inhalation and intranasal administration are also contemplated. Depending on the route of administration, the plasma kallikrein binding protein may be coated in a material to protect the compound from the action of acids and other natural conditions that may inactivate the compound.

A pharmaceutically acceptable salt is a salt that retains the desired biological activity of the compound and does not impart any undesired toxicological effects (see e.g., Berge, S. M., et al., 1977, J. Pharm. Sci. 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous, and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids, and the like. Base addition salts include those derived from alkaline earth metals, such as sodium, potassium, magnesium, calcium, and the like, as well as from nontoxic organic amines, such as N,N'-dibenzylethylenediamine, N-methylglucamine, chloroprocaine, choline, diethanolamine, ethylenediamine, procaine, and the like.

The compositions may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form can depend on the intended mode of administration and therapeutic application. Many compositions are in the form of injectable or infusible solutions, such as compositions similar to those used for administration of humans with antibodies. An exemplary mode of administration is parenteral (e.g., intravenous, subcutaneous, intraperitoneal, intramuscular). In one embodiment, the plasma kallikrein binding protein is administered by intravenous infusion or injection. In another preferred embodiment, the plasma kallikrein binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

A plasma kallikrein binding protein can be administered by a variety of methods, although for many applications, the preferred route/mode of administration is intravenous injection or infusion. For example, for therapeutic applications, the plasma kallikrein binding protein can be administered by intravenous infusion at a rate of less than 30, 20, 10, 5, or 1 mg/min to reach a dose of about 1 to 100 mg/m$^2$ or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are available. See, e.g., Sustained and Controlled Release Drug Delivery Systems, J. R. Robinson, ed., 1978, Marcel Dekker, Inc., New York.

Pharmaceutical compositions can be administered with medical devices. For example, in one embodiment, a pharmaceutical composition disclosed herein can be administered with a device, e.g., a needleless hypodermic injection device, a pump, or implant.

In certain embodiments, a plasma kallikrein binding protein can be formulated to ensure proper distribution in vivo. For example, the blood-brain barrier (BBB) excludes many highly hydrophilic compounds. To ensure that the therapeutic compounds disclosed herein cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties that are selectively transported into specific cells or organs, thus enhance targeted drug delivery (see, e.g., V. V. Ranade, 1989, J. Clin. Pharmacol. 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms can be dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of a binding protein (e.g., an antibody) disclosed herein is 0.1-20 mg/kg, more preferably 1-10 mg/kg. An anti-plasma kallikrein antibody can be administered, e.g., by intravenous infusion, e.g., at a rate of less than 30, 20, 10, 5, or 1 mg/min to reach a dose of about 1 to 100 mg/m$^2$ or about 5 to 30 mg/m$^2$. For binding proteins smaller in molecular weight than an antibody, appropriate amounts can be proportionally less. Dosage values may vary with the type and severity of the condition to be alleviated. For a particular subject, specific dosage regimens can be adjusted over time according to the individual need and the professional judgment of the person administering or supervising the administration of the compositions.

The pharmaceutical compositions disclosed herein may include a "therapeutically effective amount" or a "prophylactically effective amount" of a plasma kallikrein binding protein disclosed herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the protein to elicit a desired response in the individual. A therapeutically effective amount is also one in which any toxic or detrimental effects of the composition are outweighed by the therapeutically beneficial effects.

A "therapeutically effective dosage" preferably modulates a measurable parameter, e.g., levels of circulating IgG antibodies by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., a plasma kallikrein associated disease. Alternatively, this property of a composition can be evaluated by examining the ability of the compound to modulate a parameter in vitro.

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

Stabilization and Retention

In one embodiment, a plasma kallikrein binding protein is physically associated with a moiety that improves its stabilization and/or retention in circulation, e.g., in blood, serum, lymph, or other tissues, e.g., by at least 1.5, 2, 5, 10, or 50 fold. For example, a plasma kallikrein binding protein can be associated with a polymer, e.g., a substantially non-antigenic polymer, such as polyalkylene oxides or polyethylene oxides. Suitable polymers will vary substantially by weight. Polymers having molecular number average weights ranging from about 200 to about 35,000 (or about 1,000 to about 15,000, and 2,000 to about 12,500) can be used. For example, a plasma kallikrein binding protein can be conjugated to a water soluble polymer, e.g., hydrophilic polyvinyl polymers, e.g., polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained.

A plasma kallikrein binding protein can also be associated with a carrier protein, e.g., a serum albumin, such as a human serum albumin (see e.g., Smith, B J. et al., 2001 Bioconjug Chem 12(5): 750-756). For example, a translational fusion can be used to associate the carrier protein with the plasma kallikrein binding protein.

A plasma kallikrein binding protein can also be modified as a HESylation derivative. Processes for HESylation of a plasma kallikrein binding protein utilize hydroxyethyl starch to modify the protein. HESylation of a protein can extend the circulating half-life of the protein and also reduce renal clearance.

Kits

A plasma kallikrein binding protein described herein can be provided in a kit, e.g., as a component of a kit. For example, the kit includes (a) a plasma kallikrein binding protein, e.g., a composition (e.g., a pharmaceutical composition) that includes a plasma kallikrein binding protein, and, optionally (b) informational material. The informational material can be descriptive, instructional, marketing or other material that relates to a method described herein and/or the use of a plasma kallikrein binding protein, e.g., for a method described herein.

The informational material of the kit is not limited in its form. In one embodiment, the informational material can include information about production of the compound, molecular weight of the compound, concentration, date of expiration, batch or production site information, and so forth. In one embodiment, the informational material relates to using the binding protein to treat, prevent, or diagnosis of disorders and conditions, e.g., a plasma kallikrein associated disease or condition.

In one embodiment, the informational material can include instructions to administer a plasma kallikrein binding protein in a suitable manner to perform the methods described herein, e.g., in a suitable dose, dosage form, or mode of administration (e.g., a dose, dosage form, or mode of administration described herein). In another embodiment, the informational material can include instructions to administer a plasma kallikrein binding protein to a suitable subject, e.g., a human, e.g., a human having, or at risk for, a disorder or condition described herein, e.g., a plasma kallikrein associated disease or condition. For example, the material can include instructions to administer a plasma kallikrein binding protein to a patient with a disorder or condition described herein, e.g., a plasma kallikrein associated disease. The informational material of the kits is not limited in its form. In many cases, the informational material, e.g., instructions, is provided in print but may also be in other formats, such as computer readable material.

A plasma kallikrein binding protein can be provided in any form, e.g., liquid, dried or lyophilized form. It is preferred that a plasma kallikrein binding protein be substantially pure and/or sterile. When a plasma kallikrein binding protein is provided in a liquid solution, the liquid solution preferably is an aqueous solution, with a sterile aqueous solution being preferred. When a plasma kallikrein binding protein is provided as a dried form, reconstitution generally is by the addition of a suitable solvent. The solvent, e.g., sterile water or buffer, can optionally be provided in the kit.

The kit can include one or more containers for the composition containing a plasma kallikrein binding protein. In some embodiments, the kit contains separate containers, dividers or compartments for the composition and informational material. For example, the composition can be contained in a bottle, vial, or syringe, and the informational material can be contained in association with the container. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of a plasma kallikrein binding protein. For example, the kit includes a plurality of syringes, ampules, foil packets, or blister packs, each containing a single unit dose of a plasma kallikrein binding protein. The containers of the kits can be air tight, waterproof (e.g., impermeable to changes in moisture or evaporation), and/or light-tight.

The kit optionally includes a device suitable for administration of the composition, e.g., a syringe, inhalant, dropper (e.g., eye dropper), swab (e.g., a cotton swab or wooden swab), or any such delivery device. In one embodiment, the device is an implantable device that dispenses metered doses of the binding protein. The disclosure also features a method of providing a kit, e.g., by combining components described herein.

Treatments

Proteins that bind to plasma kallikrein, e.g., as described herein, have therapeutic and prophylactic utilities, particularly in human subjects. These binding proteins are administered to a subject to treat, prevent, and/or diagnose a variety of disorders and conditions, including e.g., a plasma kallikrein associated disease, or even to cells in culture, e.g., in vitro or ex vivo. For example, these binding proteins can be used to modify the effects of plasma kallikrein released from cells in culture (Lilla et al., J Biol. Chem. 284(20):13792-13803 (2009)). Treating includes administering an amount effective to alleviate, relieve, alter, remedy, ameliorate, improve or affect the disorder, the symptoms of the disorder or the predisposition toward the disorder. The treatment may also delay onset, e.g., prevent onset, or prevent deterioration of a disease or condition.

As used herein, an amount of a target-binding agent effective to prevent a disorder, or a prophylactically effective amount of the binding agent refers to an amount of a target binding agent, e.g., an plasma kallikrein binding protein, e.g., an anti-plasma kallikrein antibody described herein, which is effective, upon single- or multiple-dose administration to the subject, for preventing or delaying the occurrence of the onset or recurrence of a disorder, e.g., a disorder described herein, e.g., a plasma kallikrein associated disease.

Methods of administering plasma kallikrein binding proteins and other agents are also described in "Pharmaceutical Compositions." Suitable dosages of the molecules used can depend on the age and weight of the subject and the particular drug used. The binding proteins can be used as competitive agents to inhibit, reduce an undesirable interaction, e.g., between plasma kallikrein and its substrate (e.g., Factor XII or HMWK). The dose of the plasma kallikrein binding protein can be the amount sufficient to block 90%, 95%, 99%, or 99.9% of the activity of plasma kallikrein in the patient, especially at the site of disease. Depending on the disease, this may require 0.1, 1.0, 3.0, 6.0, or 10.0 mg/Kg. For an IgG having a molecular mass of 150,000 g/mole (two binding sites), these doses correspond to approximately 18 nM, 180 nM, 540 nM, 1.08 µM, and 1.8 µM of binding sites for a 5 L blood volume.

In one embodiment, the plasma kallikrein binding proteins are used to inhibit an activity (e.g., inhibit at least one activity of plasma kallikrein, e.g., reduce Factor XIIa and/or bradykinin production) of plasma kallikrein, e.g., in vivo. The binding proteins can be used by themselves or conjugated to an agent, e.g., a cytotoxic drug, cytotoxin enzyme, or radioisotope. This method includes: administering the binding protein alone or attached to an agent (e.g., a cytotoxic drug), to a subject requiring such treatment. For example, plasma kallikrein binding proteins that do not substantially inhibit plasma kallikrein may be used to deliver nanoparticles containing agents, such as toxins, to plasma kallikrein associated cells or tissues, e.g., to treat a plasma kallikrein-associate disorder.

Because the plasma kallikrein binding proteins recognize plasma kallikrein expressing cells and can bind to cells that are associated with (e.g., in proximity of or intermingled with) a plasma kallikrein associated disorder or condition, plasma kallikrein binding proteins can be used to inhibit an activity (e.g., inhibit at least one activity of plasma kallikrein, e.g., reduce Factor XIIa and/or bradykinin production) any such cells and inhibit the plasma kallikrein associated disease. Reducing plasma kallikrein activity can indirectly inhibit cells which may be dependent on the plasma kallikrein activity for the development and/or progression of a plasma kallikrein-associated disorder.

The binding proteins may be used to deliver an agent (e.g., any of a variety of cytotoxic and therapeutic drugs) to cells and tissues where plasma kallikrein is present. Exemplary agents include a compound emitting radiation, molecules of plants, fungal, or bacterial origin, biological proteins, and mixtures thereof. The cytotoxic drugs can be intracellularly acting cytotoxic drugs, such as toxins short range radiation emitters, e.g., short range, high energy α-emitters.

To target plasma kallikrein expressing cells, a prodrug system can be used. For example, a first binding protein is conjugated with a prodrug which is activated only when in close proximity with a prodrug activator. The prodrug activator is conjugated with a second binding protein, preferably one which binds to a non competing site on the target molecule. Whether two binding proteins bind to competing or non competing binding sites can be determined by conventional competitive binding assays. Exemplary drug prodrug pairs are described in Blakely et al., (1996) Cancer Research, 56:3287 3292.

The plasma kallikrein binding proteins can be used directly in vivo to eliminate antigen-expressing cells via natural complement-dependent cytotoxicity (CDC) or antibody dependent cellular cytotoxicity (ADCC). The binding proteins described herein can include complement binding effector domain, such as the Fc portions from IgG1, -2, or -3 or corresponding portions of IgM which bind complement. In one embodiment, a population of target cells is ex vivo treated with a binding agent described herein and appropriate effector cells. The treatment can be supplemented by the addition of complement or serum containing complement. Further, phagocytosis of target cells coated with a binding protein described herein can be improved by binding of complement proteins. In another embodiment target, cells coated with the binding protein which includes a complement binding effector domain are lysed by complement.

Methods of administering plasma kallikrein binding proteins are described in "Pharmaceutical Compositions." Suitable dosages of the molecules used will depend on the age and weight of the subject and the particular drug used. The binding proteins can be used as competitive agents to inhibit or reduce an undesirable interaction, e.g., between a natural or pathological agent and the plasma kallikrein.

The plasma kallikrein binding protein can be used to deliver macro and micromolecules, e.g., a gene into the cell for gene therapy purposes into the endothelium or epithelium and target only those tissues expressing the plasma kallikrein. The binding proteins may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as short range radiation emitters, including, for example, short range, high energy α emitters, as described herein.

In the case of polypeptide toxins, recombinant nucleic acid techniques can be used to construct a nucleic acid that encodes the binding protein (e.g., antibody or antigen-binding fragment thereof) and the cytotoxin (or a polypeptide component thereof) as translational fusions. The recombinant nucleic acid is then expressed, e.g., in cells and the encoded fusion polypeptide isolated.

Alternatively, the plasma kallikrein binding protein can be coupled to high energy radiation emitters, for example, a radioisotope, such as $^{131}I$, a γ-emitter, which, when localized at a site, results in a killing of several cell diameters. See, e.g., S. E. Order, "Analysis, Results, and Future Prospective of the Therapeutic Use of Radiolabeled Antibody in Cancer Therapy", *Monoclonal Antibodies for Cancer Detection and Therapy*, R. W. Baldwin et al. (eds.), pp 303 316 (Academic Press 1985). Other suitable radioisotopes include a emitters, such as $^{212}$Bi, $^{213}$Bi, and $^{211}$At, and b emitters, such as $^{186}$Re and $^{90}$Y. Moreover, $^{177}$Lu may also be used as both an imaging and cytotoxic agent.

Radioimmunotherapy (RIT) using antibodies labeled with $^{131}$I, $^{90}$Y and $^{177}$Lu is under intense clinical investigation. There are significant differences in the physical characteristics of these three nuclides and as a result, the choice of radionuclide is very critical in order to deliver maximum radiation dose to a tissue of interest. The higher beta energy particles of $^{90}$Y may be good for bulky tumors. The relatively low energy beta particles of $^{131}$I are ideal, but in vivo dehalogenation of radioiodinated molecules is a major disadvantage for internalizing antibody. In contrast, $^{177}$Lu has low energy beta particle with only 0.2-0.3 mm range and delivers much lower radiation dose to bone marrow compared to $^{90}$Y. In addition, due to longer physical half-life (compared to $^{90}$Y), the residence times are higher. As a result, higher activities (more mCi amounts) of $^{177}$Lu labeled agents can be administered with comparatively less radiation dose to marrow.

There have been several clinical studies investigating the use of $^{177}$Lu labeled antibodies in the treatment of various cancers. (Mulligan T et al., 1995, *Clin. Canc. Res.* 1: 1447-1454; Meredith R F, et al., 1996, *J. Nucl. Med.* 37:1491-1496; Alvarez R D, et al., 1997, *Gynecol. Oncol.* 65: 94-101).

Exemplary Diseases and Conditions

A plasma kallikrein binding protein described herein is useful to treat (or prevent) a disease or condition in which plasma kallikrein activity is implicated, e.g., a disease or condition described herein, or to treat (or prevent) one or more symptoms associated therewith. In some embodiments, the plasma kallikrein binding protein (e.g., plasma kallikrein binding IgG or Fab) inhibits plasma kallikrein activity.

Examples of such diseases and conditions which can be treated (or prevented) by a plasma kallikrein binding protein described herein include: rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. A plasma kallikrein binding protein described herein can also be used to promote wound healing. A plasma kallikrein binding protein described herein can also be used as an oncology treatment by mechanisms that include, but are not limited to, blocking production of pro-angiogenic bradykinin.

A therapeutically effective amount of a plasma kallikrein binding protein can be administered to a subject having or suspected of having a disorder in which plasma kallikrein activity is implicated, thereby treating (e.g., ameliorating or improving a symptom or feature of a disorder, slowing, stabilizing and/or halting disease progression) the disorder.

The plasma kallikrein binding protein can be administered in a therapeutically effective amount. A therapeutically effective amount of a plasma kallikrein binding protein is the amount which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition are outweighed by the therapeutically beneficial effects. A therapeutically effective dosage preferably modulates a measurable parameter, favorably, relative to untreated subjects. The ability of a compound to affect (e.g., inhibit) a measurable parameter can be evaluated in an animal model system predictive of efficacy in a human disorder.

Dosage regimens can be adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

Rheumatoid Arthritis

Rheumatoid arthritis (RA) is an autoimmune, chronic inflammatory disease that causes joint swelling and pain and normally results in joint destruction. RA generally follows a relapsing/remitting course, with "flares" of disease activity interspersed with remissions of disease symptoms. RA is associated with a number of additional inflammatory disorders, including Sjogren's syndrome (dry eyes and mouth caused by inflammation of tear and saliva glands), pleuritis (inflammation of the pleura that causes pain upon deep breath and coughing), rheumatoid nodules (nodular sites of inflammation that develop within the lungs), pericarditis (inflammation of the pericardium that causes pain when lying down or leaning forward), Felty syndrome (splenomegaly and leucopenia observed in conjunction with RA, making the subject prone to infection), and vasculitis (an inflammation of the blood vessels which can block blood flow). Plasma kallikrein has been implicated in rheumatoid arthritis.

Symptoms of active RA include fatigue, lack of appetite, low grade fever, muscle and joint aches, and stiffness. Muscle and joint stiffness are usually most notable in the morning and after periods of inactivity. During flares, joints frequently become red, swollen, painful, and tender, generally as a consequence of synovitis.

Treatment for rheumatoid arthritis involves a combination of medications, rest, joint strengthening exercises, and joint protection. Two classes of medications are used in treating rheumatoid arthritis: anti-inflammatory "first-line drugs," and "Disease-Modifying Antirheumatic Drugs" (DMARDs). The first-line drugs include NSAIDS (e.g., aspirin, naproxen, ibuprofen, and etodolac) and cortisone (corticosteroids). DMARDs, such as gold (e.g., gold salts, gold thioglucose, gold thiomalate, oral gold), methotrexate, sulfasalazine, D-penicillamine, azathioprine, cyclophosphamide, chlorambucil, and cyclosporine, leflunomide, etanercept, infliximab, anakinra, and adalimumab, and hydroxychloroquine, promote disease remission and prevent progressive joint destruction, but they are not anti-inflammatory agents.

The disclosure provides methods of treating (e.g., ameliorating, stabilizing, or eliminating one or more symptoms or ameliorating or stabilizing the subject's score on a RA scale) rheumatoid arthritis by administering a plasma kallikrein binding protein (e.g., a therapeutically effective amount of a plasma kallikrein binding protein) to a subject having or suspected of having RA. Additionally provided are methods of treating RA by administering a plasma kallikrein binding protein (e.g., a therapeutically effective amount of a plasma kallikrein binding protein) in combination with a second therapy, e.g., with at least one anti-inflammatory "first line drug" (e.g., an NSAID and/or cortisone) and/or a DMARD. The disclosure also provides methods of preventing rheumatoid arthritis or a symptom thereof by administering a plasma kallikrein binding protein (e.g., a prophylactically effective amount of a plasma kallikrein binding protein) to a subject at risk of developing RA (e.g., a subject having a family member with RA or a genetic predisposition thereto).

Further provided are methods of treating (e.g., ameliorating, stabilizing, or eliminating one or more symptoms) rheumatoid arthritis associated disorders (Sjogren's syndrome, pleuritis, pulmonary rheumatoid nodules, pericarditis, Felty syndrome, and vasculitis) by administering a plasma kallikrein binding protein (e.g., a therapeutically effective amount of a plasma kallikrein binding protein) to a subject having or suspected of having RA.

Scales useful for assessing RA and symptoms of RA include, e.g., the Rheumatoid Arthritis Severity Scale (RASS; Bardwell et al., (2002) *Rheumatology* 41(1):38-45), SF-36 Arthritis Specific Health Index (ASHI; Ware et al., (1999) *Med. Care.* 37(5 Suppl):MS40-50), Arthritis Impact Measurement Scales or Arthritis Impact Measurement Scales 2 (AIMS or AIMS2; Meenan et al. (1992) *Arthritis Rheum.* 35(1):1-10); the Stanford Health Assessment Questionnaire (HAQ), HAQII, or modified HAQ (see, e.g., Pincus et al. (1983) *Arthritis Rheum.* 26(11):1346-53).

Guidance for the determination of the dosage that delivers a therapeutically effective amount of a plasma kallikrein binding protein may be obtained from animal models of rheumatoid arthritis, such as collagen-induced arthritis (CIA), which is induced, typically in rodents, by immunization with autologous or heterologous type II collagen in adjuvant (Williams et al. Methods Mol. Med. 98:207-16 (2004)).

Gout

Gout is a condition that results from crystals of uric acid depositing in tissues of the body. Gout is characterized by an overload of uric acid in the body and recurring attacks of joint inflammation (arthritis). Chronic gout can lead to deposits of hard lumps of uric acid in and around the joints, decreased kidney function, and kidney stones. Gout is often related to an inherited abnormality in the body's ability to process uric acid. Uric acid is a breakdown product of purines, which are part of many foods. An abnormality in handling uric acid can cause attacks of painful arthritis (gout attack), kidney stones, and blockage of the kidney filtering tubules with uric acid crystals, leading to kidney failure. Some patients may only develop elevated blood uric acid levels (hyperuricemia) without having arthritis or kidney problems.

Symptoms of gout include, e.g., excruciating and unexpected pain, swelling, redness, warmth and stiffness in the affected foot or other parts of the body, and low-grade fever.

Treatments for gout include, e.g., nonsteroidal anti-inflammatory drugs (NSAIDs), colchicine and oral glucocorticoids, intra-articular glucocorticoids administered via a joint injection, xanthine oxidase inhibitors (e.g., allopurinol, febuxostat), uricosurics (e.g., probenecid, EDTA), urate oxidases (e.g., pegloticase), sodium bicarbonate, and low purine diet.

The disclosure provides methods of treating (e.g., ameliorating, stabilizing, or eliminating one or more symptoms or the worsening of) gout by administering a plasma kallikrein binding protein (e.g., a therapeutically effective amount of a plasma kallikrein binding protein) to a subject having or suspected of having gout. Additionally provided are methods of treating gout by administering a plasma kallikrein binding protein (e.g., a therapeutically effective amount of a kallikrein binding protein) in combination with a second therapy, e.g., an NSAID, a colchicine, an oral glucocorticoid, an intraarticular glucocorticoid administered via a joint injection, a xanthine oxidase inhibitor (e.g., allopurinol, febuxostat), a uricosuric (e.g., probenecid, EDTA), a urate oxidase (e.g., pegloticase), sodium bicarbonate, and/or low purine diet. The disclosure also provides methods of preventing gout or a symptom thereof by administering a plasma kallikrein binding protein (e.g., a prophylactically effective amount of a plasma kallikrein binding protein) to a subject at risk of developing gout (e.g., a subject having a family member with gout or a genetic predisposition thereto).

Guidance for the determination of the dosage that delivers a therapeutically effective amount of a plasma kallikrein binding protein may be obtained from animal models of gout, see, e.g., Reginato and Olsen, Curr Opin Rheumatol. 19(2): 134-45 (2007) and references cited therein.

Intestinal Bowel Disease (IBD)

Inflammatory bowel disease (IBD) is a group of inflammatory conditions of the large intestine and, in some cases, the small intestine. The main forms of IBD are Crohn's disease and ulcerative colitis (UC). Accounting for far fewer cases are other forms of IBD: collagenous colitis, lymphocytic colitis, ischaemic colitis, diversion colitis, Behçet's syndrome, infective colitis, and indeterminate colitis. The main difference between Crohn's disease and UC is the location and nature of the inflammatory changes. Crohn's can affect any part of the gastrointestinal tract, from mouth to anus (skip lesions), although a majority of the cases start in the terminal ileum. Ulcerative colitis, in contrast, is restricted to the colon and the rectum. Microscopically, ulcerative colitis is restricted to the mucosa (epithelial lining of the gut), while Crohn's disease affects the whole bowel wall. Finally, Crohn's disease and ulcerative colitis present with extra-intestinal manifestations (such as liver problems, arthritis, skin manifestations and eye problems) in different proportions.

Symptoms of IBD include abdominal pain, vomiting, diarrhea, hematochezia, weight loss, weight gain and various associated complaints or diseases (arthritis, pyoderma gangrenosum, primary sclerosing cholangitis). Diagnosis is generally by colonoscopy with biopsy of pathological lesions. Rarely, a definitive diagnosis of neither Crohn's disease nor ulcerative colitis can be made because of idiosyncrases in the presentation. In this case, a diagnosis of indeterminate colitis may be made.

Treatment for IBD, depending on the level of severity, may require immunosuppression to control the symptoms. Immunosuppresives such as azathioprine, methotrexate, or 6-mercaptopurine can be used. More commonly, treatment of IBD requires a form of mesalamine. Often, steroids are used to control disease flares and were once acceptable as a maintenance drug. Biologicals, such as infliximab, have been used to treat patients with Crohn's disease or Ulcerative Colitis. Severe cases may require surgery, such as bowel resection, strictureplasty or a temporary or permanent colostomy or ileostomy. Alternative medicine treatments for IBD exist in various forms however such methods concentrate on controlling underlying pathology in order to avoid prolonged steroidal exposure or surgical excision. Usually the treatment is started by administering drugs, such as prednisone, with high anti-inflammatory affects. Once the inflammation is successfully controlled, the patient is usually switched to a lighter drug, such as asacol—a mesalamine—to keep the disease in remission. If unsuccessful, a combination of the aforementioned immunosuppressant drugs with a mesalamine (which may also have an anti-inflammatory effect) may or may not be administered, depending on the patient.

The disclosure provides methods of treating (e.g., ameliorating, stabilizing, or eliminating one or more symptoms of) IBD by administering a plasma kallikrein binding protein (e.g., a therapeutically effective amount of a plasma kallikrein binding protein) to a subject having or suspected of having IBD. Additionally provided are methods of treating IBD by administering a plasma kallikrein binding protein (e.g., a therapeutically effective amount of a kallikrein binding protein) in combination with a second therapy, e.g., an immunosuppressive (e.g., azathioprine, methotrexate, 6-mercaptopurine), a mesalamine, a steroid, and/or infliximab. The disclosure also provides methods of preventing IBD or a symptom thereof by administering a plasma kallikrein binding protein (e.g., a prophylactically effective amount of a plasma kallikrein binding protein) to a subject at risk of developing IBD (e.g., a subject having a family member with IBD or a genetic predisposition thereto).

Guidance for the determination of the dosage that delivers a therapeutically effective amount of a plasma kallikrein binding protein may be obtained from animal models of IBD, see, e.g., those described in U.S. Pat. No. 6,114,382, WO 2004/071186, and references cited therein.

Oral Mucositis

Oral mucositis is the painful inflammation and ulceration of the mucous membranes in the mouth, usually as an adverse effect of chemotherapy and radiotherapy treatment for cancer.

Symptoms of oral mucositis include, e.g., ulcers, peripheral erythema, burning sensation accompanied by reddening, trouble speaking, eating, or even opening the mouth, and dyseusia (alteration in taste perception).

Treatment for oral mucositis includes oral hygiene (salt mouthwash, GELCLAIR®, CAPHOSOL®, MUGARD®), palifermin (a human keratinocyte growth factor), cytokines and other modifiers of inflammation (e.g., IL-1, IL-11, TGF-beta3), amino acid supplementation (e.g., glutamine), vitamins, colony-stimulating factors, cryotherapy, and laser therapy.

The disclosure provides methods of treating (e.g., ameliorating, reducing, or eliminating one or more symptoms, or stabilizing the subject's score on a mucositis scale) oral mucositis by administering a plasma kallikrein binding protein (e.g., a therapeutically effective amount of a plasma kallikrein binding protein) to a subject having or suspected of having oral mucositis. Additionally provided are methods of treating oral mucositis by administering a plasma kallikrein binding protein (e.g., a therapeutically effective amount of a plasma kallikrein binding protein) in combination with a second therapy, e.g., oral hygiene (salt mouthwash, GELCLAIR®, CAPHOSOL®, MUGARD®), palifermin (a human keratinocyte growth factor), a cytokine and/or a modifier of inflammation (e.g., IL-1, IL-11, TGF-beta3), an amino acid supplementation (e.g., glutamine), a vitamin, a colony-stimulating factor, cryotherapy, and/or laser therapy. The disclosure also provides methods of preventing oral mucositis or a symptom thereof by administering a plasma kallikrein binding protein (e.g., a prophylactically effective amount of a plasma kallikrein binding protein) to a subject at risk of developing oral mucositis (e.g., a subject that has undergone or is undergoing chemotherapy or radiotherapy).

Scales useful for assessing oral mucositis include the World Health Organization (WHO) Oral Toxicity score (Handbook for reporting results of cancer treatment. Geneva, Switzerland: World Health Organization; 1979:15-22), National Cancer Institute Common Toxicity Criteria (NCI-CTC) for Oral Mucositis (National Cancer Institute Common Toxicity Criteria. Version 2.0, Jun. 1, 1999, Sonis et al., Cancer. 85:2103-2113 (1999)), and Oral Mucositis Assessment Scale (OMAS).

Guidance for the determination of the dosage that delivers a therapeutically effective amount of a plasma kallikrein binding protein may be obtained from animal models of oral mucositis, such as an animal model of oral mucositis induced by conditioning regimen of haematopoietic stem cell transplantation (Chen et al., Zhonghua Kou Qiang Yi Xue Za Zhi. 42(11):672-6 (2007)).

Neuropathic Pain

Neuropathic pain is a complex, chronic pain state that usually is accompanied by tissue injury. With neuropathic pain, the nerve fibers themselves may be damaged, dysfunctional or injured. These damaged nerve fibers send incorrect signals to other pain centers. The impact of nerve fiber injury includes a change in nerve function both at the site of injury and areas around the injury.

Symptoms of neuropathic pain include, e.g., shooting and burning pain and tingling and numbness.

Treatments for neuropathic pain include, e.g., medications (e.g., non-steroidal anti-inflammatory drugs (NSAIDs) (e.g., ALEVE®, MOTRIN®, or morphine), anticonvulsant, and antidepressant drugs), and invasive or implantable devices (e.g., electrical stimulation).

The disclosure provides methods of treating (e.g., ameliorating, reducing, or eliminating one or more symptoms of or stabilizing the subject's score on a pain scale) neuropathic pain by administering a plasma kallikrein binding protein (e.g., a therapeutically effective amount of a plasma kallikrein binding protein) to a subject having or suspected of having neuropathic pain. Additionally provided are methods of treating neuropathic pain by administering a plasma kallikrein binding protein (e.g., a therapeutically effective amount of a plasma kallikrein binding protein) in combination with a second therapy, e.g., a nonsurgical treatment ((e.g., a non-steroidal anti-inflammatory drug (NSAID) (e.g., ALEVE®, MOTRIN®, or morphine), an anticonvulsant, and/or an antidepressant drug), and/or an invasive or implantable device (e.g., electrical stimulation). The disclosure also provides methods of preventing neuropathic pain or a symptom thereof by administering a plasma kallikrein binding protein (e.g., a prophylactically effective amount of a plasma kallikrein binding protein) to a subject at risk of developing neuropathic pain (e.g., a subject that has experienced tissue injury).

Scales useful for the assessment of neuropathic pain include, e.g., Wong-Baker FACES Pain Rating Scale (Wong-Baker FACES Pain Rating Scale Foundation), Visual analog scale (VAS) (Huskisson, J. Rheumatol. 9 (5): 768-9 (1982)), McGill Pain Questionnaire (MPQ) (Melzack, Pain 1 (3): 277-99 (1975)), Descriptor differential scale (DDS) (Gracety and Kwilosz, Pain 35 (3): 279-88 (1988)), Faces Pain Scale-Revised (FPS-R) (Hicks et al., Pain 93 (2): 173-83 (2001)), Numerical 11 point box (BS-11) (Jensen et al., Clin J Pain 5 (2): 153-9 (1989)), Numeric Rating Scale (NRS-11) (Hartrick et al., Pain Pract 3 (4): 310-6 (2003)), Dolorimeter Pain Index (DPI) (Hardy et al., (1952). Pain Sensations and Reactions. Baltimore: The Williams & Wilkins Co.), and Brief Pain Inventory (BPI) (Cleeland and Ryan *Ann. Acad. Med. Singap.* 23 (2): 129-38 (1994)).

Guidance for the determination of the dosage that delivers a therapeutically effective amount of a plasma kallikrein binding protein may be obtained from animal models of neuropathic pain, see, e.g., those described in Martin et al., Methods Mol. Med. 84:233-42 (2003) and references cited therein.

Inflammatory Pain

Inflammatory pain is caused by an insult such as penetration wounds, burns, extreme cold, fractures, arthritis, autoimmune conditions, excessive stretching, infections and vasoconstriction to the integrity of tissues at a cellular level. During inflammation a complex neuro-immune interaction results in primary hyperalgesia, in which a large range of inflammatory molecules including prostaglandins and bradykinin induce and maintain the altered nociceptor sensitivity.

Treatments for inflammatory pain include, e.g., non-steroidal anti-inflammatory drugs (NSAIDs) and corticosteroids.

The disclosure provides methods of treating (e.g., ameliorating, reducing, or eliminating one or more symptoms of) inflammatory pain by administering a plasma kallikrein binding protein (e.g., a therapeutically effective amount of a plasma kallikrein binding protein) to a subject having or suspected of having inflammatory pain. Additionally provided are methods of treating inflammatory pain by administering a plasma kallikrein binding protein (e.g., a therapeutically effective amount of a plasma kallikrein binding protein) in combination with a second therapy, e.g., a nonsteroidal anti-inflammatory drug (NSAID) and/or a corticosteroid. The disclosure also provides methods of preventing inflammatory pain or a symptom thereof by administering a plasma kallikrein binding protein (e.g., a prophylactically effective amount of a plasma kallikrein binding protein) to a subject at risk of developing inflammatory pain (e.g., a subject that has experienced an insult, e.g., such as a penetration wound, a burn, extreme cold, a fracture, arthritis, an autoimmune condition, excessive stretching, or infection).

Scales useful for the assessment of inflammatory pain include, e.g., Wong-Baker FACES Pain Rating Scale (Wong-Baker FACES Pain Rating Scale Foundation), Visual analog scale (VAS) (Huskisson, J. Rheumatol. 9 (5): 768-9 (1982)), McGill Pain Questionnaire (MPQ) (Melzack, Pain 1 (3): 277-99 (1975)), Descriptor differential scale (DDS) (Gracety and Kwilosz, Pain 35 (3): 279-88 (1988)), Faces Pain Scale-Revised (FPS-R) (Hicks et al., Pain 93 (2): 173-83 (2001)), Numerical 11 point box (BS-11) (Jensen et al., Clin J Pain 5 (2): 153-9 (1989)), Numeric Rating Scale (NRS-11) (Hartrick et al., Pain Pract 3 (4): 310-6 (2003)), Dolorimeter Pain Index (DPI) (Hardy et al., (1952). Pain Sensations and Reactions. Baltimore: The Williams & Wilkins Co.), and Brief Pain Inventory (BPI) (Cleeland and Ryan *Ann. Acad. Med. Singap.* 23 (2): 129-38 (1994)).

Guidance for the determination of the dosage that delivers a therapeutically effective amount of a plasma kallikrein binding protein may be obtained from animal models of inflammatory pain such as an animal model of chronic inflammatory pain (Wilson et al., Eur J Pain. 10(6):537-49 (2006)) and an inflammatory model of pain and hyperalgesia (Ren and Dubner, ILAR J. 40(3):111-118 (1999)).

Spinal Stenosis

Spinal stenosis is a medical condition in which the spinal canal narrows and compresses the spinal cord and nerves. This is usually due to the common occurrence of spinal degeneration that occurs with aging. It can also sometimes be caused by spinal disc herniation, osteoporosis or a tumor. Spinal stenosis may affect the cervical, thoracic or lumbar spine. In some cases, it may be present in all three places in the same patient.

Symptoms of spinal stenosis include, e.g., pain or cramping in the legs, radiating back and hip pain, pain in the neck and shoulders, loss of balance, and loss of bowel or bladder function (cauda equina syndrome).

Treatments for spinal stenosis include, e.g., nonsurgical treatments (e.g., physical therapy, non-steroidal anti-inflammatory drugs (NSAIDs) (e.g., aspirin, ibuprofen and indomethacin), analgesics (e.g., acetaminophen), chondroitin sulfate, glucosamine, rest or restricted activity, back brace or corset, epidural steroid injections (e.g., corticosteroid)), and surgery (e.g., decompressive laminectomy, laminotomy and fusion).

The disclosure provides methods of treating (e.g., ameliorating, reducing, or eliminating one or more symptoms of) spinal stenosis by administering a plasma kallikrein binding protein (e.g., a therapeutically effective amount of a plasma kallikrein binding protein) to a subject having or suspected of having spinal stenosis. Additionally provided are methods of treating spinal stenosis by administering a plasma kallikrein binding protein (e.g., a therapeutically effective amount of a plasma kallikrein binding protein) in combination with a second therapy, e.g., a nonsurgical treatment (e.g., physical therapy and/or a nonsteroidal anti-inflammatory drug (NSAID) (e.g., aspirin, ibuprofen or indomethacin), an analgesic (e.g., acetaminophen), chondroitin sulfate, glucosamine, rest or restricted activity, a back brace or corset, an epidural steroid injection (e.g., corticosteroid), and/or surgery (e.g., decompressive laminectomy, laminotomy and/or fusion). The disclosure also provides methods of preventing spinal stenosis or a symptom thereof by administering a plasma kallikrein binding protein (e.g., a prophylactically effective amount of a plasma kallikrein binding protein) to a subject at risk of developing spinal stenosis (e.g., a subject that has spinal degeneration).

Guidance for the determination of the dosage that delivers a therapeutically effective amount of a plasma kallikrein binding protein may be obtained from animal models of spinal stenosis, such as a model of lumbar spinal stenosis (Sekiguchi et al., Spine 29, 1105-1111 (2004)).

Arterial and Venous Thrombosis

Arterial thrombosis is the formation of a thrombus within an artery. In most cases, arterial thrombosis follows rupture of atheroma, and is therefore referred to as atherothrombosis.

Arterial thrombosis is associated with a number of disorders, including stroke and myocardial infarction. In thrombotic stroke, a thrombus (blood clot) usually forms around atherosclerotic plaques. Since blockage of the artery is gradual, onset of symptomatic thrombotic strokes is slower. Thrombotic stroke can be divided into two categories—large vessel disease and small vessel disease. The former affects vessels such as the internal carotids, vertebral and the circle of Willis. The latter can affect smaller vessels such as the branches of the circle of Willis Myocardial infarction (MI) is caused by an infarct (death of tissue due to ischemia), often due to the obstruction of the coronary artery by a thrombus. MI can quickly become fatal if emergency medical treatment is not received promptly.

Venous thrombosis is a blood clot that forms within a vein. If a piece of a blood clot formed in a vein breaks off, it can be transported to the right side of the heart, and from there into the lungs. A piece of thrombus that is transported in this way is an embolism and the process of forming a thrombus that becomes embolic is called a thromboembolism. An embolism that lodges in the lungs is a pulmonary embolism (PE). A pulmonary embolus is a very serious condition that can be fatal if not recognized and treated promptly.

Superficial venous thromboses can cause discomfort but generally do not cause serious consequences, unlike the deep venous thromboses (DVTs) that form in the deep veins of the legs or in the pelvic veins. Systemic embolisms of venous origin can occur in patients with an atrial or ventricular septal defect, through which an embolus may pass into the arterial system. Such an event is termed a paradoxical embolism.

Prevention of arterial and/or venous thrombosis includes medications (e.g., anticoagulants (e.g., heparin), aspirin, and vitamin E) and mechanical methods (e.g., mechanical leg pumps (pneumatic compression stockings)).

The disclosure provides methods of treating (e.g., ameliorating, reducing, or eliminating one or more symptoms of) arterial and/or venous thrombosis by administering a plasma kallikrein binding protein (e.g., a therapeutically effective amount of a plasma kallikrein binding protein) to a subject having or suspected of having arterial and/or venous thrombosis. Additionally provided are methods of treating arterial and/or venous thrombosis by administering a plasma kallikrein binding protein (e.g., a therapeutically effective amount of a plasma kallikrein binding protein) in combination with a second therapy, e.g., an anticoagulant (e.g., heparin), aspirin, and/or vitamin E and/or a mechanical method (e.g., a mechanical leg pump (pneumatic compression stockings). The disclosure also provides methods of preventing arterial and/or venous thrombosis or a symptom thereof by administering a plasma kallikrein binding protein (e.g., a prophylactically effective amount of a plasma kallikrein binding protein) to a subject at risk of developing arterial and/or venous thrombosis (e.g., a subject that has experienced a stroke or myocardial infarction).

Guidance for the determination of the dosage that delivers a therapeutically effective amount of a plasma kallikrein binding protein may be obtained from animal models of arterial or venous thrombosis, such as a double-tuck model of arterial thrombosis (Gomez-Jorge et al., J. Vasc. Inter. Rad. 9(4): 633-638 (1998), a model of venous thrombosis in rat with low flow conditions in the venous blood stream (Fredrich et al., Blood Coagul Fibrinolysis. 5(2):243-8 (1994)), and a canine model for venous thrombosis and spontaneous pulmonary embolism (Frisbiel, Spinal Cord 43, 635-639 (2005)).

Postoperative Ileus

Postoperative ileus is a temporary paralysis of a portion of the intestines typically after an abdominal surgery. Postoperative ileus commonly occurs for 24 to 72 hours after abdominal surgery.

Symptoms of postoperative ileus include, e.g., moderate and diffuse abdominal discomfort, constipation, abdominal distension, nausea or vomiting, lack of bowel movement and/or flatulence, and excessive belching.

Treatments for postoperative ileus include, e.g., nil per os (NPO or "Nothing by Mouth") until peristaltic sound is heard from auscultation of the area where this portion lies, nasogastric suction, parenteral feeds, and medications (e.g., lactulose and erythromycin).

The disclosure provides methods of treating (e.g., ameliorating, reducing, or eliminating one or more symptoms of) postoperative ileus by administering a plasma kallikrein binding protein (e.g., a therapeutically effective amount of a plasma kallikrein binding protein) to a subject having or suspected of having postoperative ileus. Additionally provided are methods of treating postoperative ileus by administering a plasma kallikrein binding protein (e.g., a therapeutically effective amount of a plasma kallikrein binding protein) in combination with a second therapy, e.g., nil per os, nasogastric suction, parenteral feeds, and/or a medication (e.g., lactulose and/or erythromycin). The disclosure also provides methods of preventing postoperative ileus or a symptom thereof by administering a plasma kallikrein binding protein (e.g., a prophylactically effective amount of a plasma kallikrein binding protein) to a subject at risk of developing postoperative ileus (e.g., a subject that has had abdominal surgery).

Guidance for the determination of the dosage that delivers a therapeutically effective amount of a plasma kallikrein binding protein may be obtained from animal models of postoperative ileus, such as a model to investigate postoperative ileus with strain gauge transducers in awake rats (Huge et al. J Surg Res. 74(2):112-8 (1998)).

Aortic Aneurysm

An aortic aneurysm is a general term for any swelling (dilatation or aneurysm) of the aorta, usually representing an underlying weakness in the wall of the aorta at that location. Types of aortic aneurysms include aortic root aneurysm, thoracic aortic aneurysm, abdominal aortic aneurysm, and thoracoabdominal aortic aneurysm.

Most intact aortic aneurysms do not produce symptoms. As they enlarge, symptoms of aortic aneurysm include, e.g., anxiety or feeling of stress, nausea or vomiting, clammy skin, rapid heart rate, abdominal pain, back pain may develop, leg pain or numbness, erythema nodosum (leg lesions typically found near the ankle region), and a hoarse voice as the left recurrent laryngeal nerve winding around the arch of the aorta is stretched. Once an aneurysm is ruptured, it can cause severe pain and massive internal hemorrhage, and is fatal in the absence of prompt treatment.

Treatments for aortic aneurysm include, e.g., medications, surgical treatment and endovascular treatment. Smaller aneurysms that are not at high risk for rupturing can be treated with drugs to treat high blood pressure, such as beta-blockers; or doxycycline for matrix metalloproteinase-9 inhibition. Surgical treatment typically involves opening up of the dilated portion of the aorta and insertion of a synthetic (Dacron or Gore-tex) patch tube. Endovascular treatment, as a minimally invasive alternative to open surgery repair, involves the placement of an endovascular stent via a percutaneous technique (usually through the femoral arteries) into the diseased portion of the aorta.

The disclosure provides methods of treating (e.g., stabilizing, reducing, or eliminating one or more symptoms of) aortic aneurysm by administering a plasma kallikrein binding protein (e.g., a therapeutically effective amount of a plasma kallikrein binding protein) to a subject having or suspected of having aortic aneurysm. Additionally provided are methods of treating aortic aneurysm by administering a plasma kallikrein binding protein (e.g., a therapeutically effective amount of a plasma kallikrein binding protein) in combination with a second therapy, e.g., a medication (e.g., a drug to treat high blood pressure (e.g., a beta-blocker) or doxycycline), surgery, and/or an endovascular treatment. The disclosure also provides methods of preventing aortic aneurysm or a symptom thereof by administering a plasma kallikrein binding protein (e.g., a prophylactically effective amount of a plasma kallikrein binding protein) to a subject at risk of developing aortic aneurysm (e.g., a subject that has high blood pressure).

Guidance for the determination of the dosage that delivers a therapeutically effective amount of a plasma kallikrein binding protein may be obtained from an animal model of aortic aneurysm, e.g., a rat model of abdominal aortic aneurysm using a combination of intraluminal elastase infusion and extraluminal calcium chloride exposure (Tanaka et al. J Vasc Surg. 50(6):1423-32 (2009)).

Osteoarthritis

Osteoarthritis, also known as degenerative arthritis, is characterized by the breakdown and eventual loss of the cartilage of one or more joints. Osteoarthritis occurs when the cartilage that cushions the ends of bones in the joints deteriorates over time. The smooth surface of the cartilage becomes rough, causing irritation. If the cartilage wears down completely, the ends of the bones will be damaged. Osteoarthritis commonly affects the hands, feet, spine, and large weight-bearing joints, such as the hips and knees.

Symptoms of osteoarthritis include, e.g., pain, tenderness, stiffness, loss of flexibility, grating sensation, and bone spurs.

Treatments for osteoarthritis include, e.g., conservative measures (e.g., rest, weight reduction, physical and occupational therapy) and medications (e.g., acetaminophen, pain-relieving creams applied to the skin over the joints (e.g., capsaicin, salycin, methyl salicylate, and menthol), non-steroidal anti-inflammatory drugs (NSAIDs) (e.g., aspirin, ibuprofen, nabumetone and naproxen), and Cox-2 inhibitors.

The disclosure provides methods of treating (e.g., stabilizing, reducing, or eliminating one or more symptoms or stabilizing the subject's score on an osteoarthritis scale) osteoarthritis by administering a plasma kallikrein binding protein (e.g., a therapeutically effective amount of a plasma kallikrein binding protein) to a subject having or suspected of having osteoarthritis. Additionally provided are methods of treating osteoarthritis by administering a plasma kallikrein binding protein (e.g., a therapeutically effective amount of a plasma kallikrein binding protein) in combination with a second therapy, e.g., a conservative measure (e.g., rest, weight reduction, physical and/or occupational therapy) and/or a medication (e.g., acetaminophen, a topical pain-relieving cream, an NSAID (e.g., aspirin, ibuprofen, nabumetone, or naproxen), and/or a Cox-2 inhibitor. The disclosure also provides methods of preventing osteoarthritis or a symptom thereof by administering a plasma kallikrein binding protein (e.g., a prophylactically effective amount of a plasma kallikrein binding protein) to a subject at risk of developing osteoarthritis (e.g., a subject that has had a joint injury).

Scales useful for the assessment of osteoarthritis include, e.g., the Knee Injury and Osteoarthritis Outcome Score (KOOS; Roos et al. (1998) J. Orthop. Sports Phys. Ther. 28(2):88-96), Western Ontario and McMaster Universities Osteoarthrtis Index (WOMAC; Roos et al. (2003) *Health Qual. Life Outcomes* 1(1):17), and the 36-item Short Form General Health Scale (SF-36 GHS), as well as other assessment tools known in the art.

Guidance for the determination of the dosage that delivers a therapeutically effective amount of a plasma kallikrein binding protein may be obtained from an animal model of osteoarthritis, e.g., injection of mono-iodoacetate (MIA) into the femorotibial joint of rodents which promotes loss of articular cartilage similar to that noted in human osteoarthritis (Guzman et al. Toxicol Pathol. 31(6):619-24 (2003)), and transection of the anterior cruciate ligament (ACL) in canines to induce osteoarthritis (Fife and Brandt J Clin Invest. 84(5): 1432-1439 (1989)).

Vasculitis

Vasculitis refers to a heterogeneous group of disorders that are characterized by inflammatory destruction of blood vessels. Both arteries and veins can be affected. Lymphangitis is sometimes considered a type of vasculitis. Vasculitis is primarily due to leukocyte migration and resultant damage. Vasculitis can be classified by the underlying cause, the location of the affected vessels, or the type or size of the blood vessels. Vasculitis is associated with a number of additional disorders and conditions, e.g., Kawasaki disease, Behçet's disease, Polyarteritis nodosa, Wegener's granulomatosis, Cryoglobulinemia, Takayasu's arteritis, Churg-Strauss syndrome, Giant cell arteritis (temporal arteritis), Henoch-Schönlein purpura, Rheumatic diseases (e.g., rheumatoid arthritis and systemic lupus erythematosus), cancer (e.g., lymphomas), infections (e.g., hepatitis C), exposure to chemicals and drugs (e.g., amphetamines, cocaine, and anthrax vaccines which contain the Anthrax Protective Antigen as the primary ingredient).

Symptoms of vasculitis include, e.g., fever, weight loss, palpable purpura, livedo reticularis, myalgia or myositis, arthralgia or arthritis, mononeuritis multiplex, headache, stroke, tinnitus, reduced visual acuity, acute visual loss, myocardial infarction, hypertension, gangrene, nose bleeds, bloody cough, lung infiltrates, abdominal pain, bloody stool, perforations, and glomerulonephritis.

Treatments for vasculitis include, e.g., cortisone-related medications (e.g., prednisone) and immune suppression drugs (e.g., cyclophosphamide).

The disclosure provides methods of treating (e.g., stabilizing, reducing, or eliminating one or more symptoms or stabilizing the subject's score on a vasculitis scale) vasculitis by administering a plasma kallikrein binding protein (e.g., a therapeutically effective amount of a plasma kallikrein binding protein) to a subject having or suspected of having vasculitis. Additionally provided are methods of treating vasculitis by administering a plasma kallikrein binding protein (e.g., a therapeutically effective amount of a plasma kallikrein binding protein) in combination with a second therapy (e.g., a cortisone-related medication (e.g., prednisone) and/or an immune suppression drug (e.g., cyclophosphamide)). The disclosure also provides methods of preventing vasculitis or a symptom thereof by administering a plasma kallikrein binding protein (e.g., a prophylactically effective amount of a plasma kallikrein binding protein) to a subject at risk of developing vasculitis (e.g., a subject that has had Kawasaki disease, Behçet's disease, Polyarteritis nodosa, Wegener's granulomatosis, Cryoglobulinemia, or Takayasu's arteritis, and so forth).

The disclosure also provides methods of treating (e.g., stabilizing, reducing, or eliminating one or more symptoms or stabilizing the subject's score on a vasculitis scale) vasculitis associated with systemic lupus erythematosis by administering a plasma kallikrein binding protein (e.g., a therapeutically effective amount of a plasma kallikrein binding protein) to a subject having or suspected of having vasculitis associated with systemic lupus erythematosis. Additionally provided are methods of treating vasculitis associated with systemic lupus erythematosis by administering a plasma kallikrein binding protein (e.g., a therapeutically effective amount of a plasma kallikrein binding protein) in combination with a second therapy, e.g., a cortisone-related medication (e.g., prednisone) and/or an immune suppression drug (e.g., cyclophosphamide).

Further provided are methods of treating (e.g., ameliorating, stabilizing, or eliminating one or more symptoms) a vasculitis associated disorder (Kawasaki disease, Behçet's disease, Polyarteritis nodosa, Wegener's granulomatosis, Cryoglobulinemia, Takayasu's arteritis, Churg-Strauss syndrome, Giant cell arteritis (temporal arteritis), Henoch-Schönlein purpura, Rheumatic diseases (e.g., rheumatoid arthritis and systemic lupus erythematosus), cancer (e.g., lymphomas), infections (e.g., hepatitis C), exposure to chemicals and drugs (e.g., amphetamines, cocaine, and anthrax vaccines which contain the Anthrax Protective Antigen as the primary ingredient)) by administering a plasma kallikrein binding protein (e.g., a therapeutically effective amount of a plasma kallikrein binding protein) to a subject having or suspected of having a vasculitis associated disorder. The disclosure also provides methods of preventing a vasculitis associated disorder or a symptom thereof by administering a plasma kallikrein binding protein (e.g., a prophylactically effective amount of a plasma kallikrein binding protein) to a subject at risk of developing a vasculitis associated disorder.

Scales useful for the assessment of osteoarthritis include, e.g., Birmingham Vasculitis Activity score (BVAS) version 3 (Mukhtyar et al. Ann Rheum Dis. 68(12):1827-32 (2009)), as well as other assessment tools known in the art.

Guidance for the determination of the dosage that delivers a therapeutically effective amount of a plasma kallikrein binding protein may be obtained from an animal model of vasculitis, see e.g., those described in Katz et al., Clin Rev Allergy Immunol. 35(1-2):11-8 (2008) and references cited therein.

Head Trauma

Head trauma refers to trauma to the head, which may or may not include injury to the brain. Types of head trauma include concussion, epidural hematoma, subdural hematoma, cerebral contusion, and diffuse axonal injury.

Symptoms of head trauma include, e.g., coma, confusion, drowsiness, personality change, seizures, nausea and vomiting, headache and a lucid interval, during which a patient appears conscious only to deteriorate later, leaking cerebrospinal fluid, visible deformity or depression in the head or face, an eye that cannot move or is deviated to one side can indicate that a broken facial bone is pinching a nerve that innervates eye muscles, wounds or bruises on the scalp or face, basilar skull fractures, a subcutaneous bleed over the mastoid, hemotympanum, cerebrospinal fluid rhinorrhea, and otorrhea.

Treatments for head trauma include, e.g., controlling elevated intracranial pressure (e.g., sedation, paralytics, cerebrospinal fluid diversion), decompressive craniectomy, barbiturate coma, hypertonic saline, and hypothermia.

The disclosure provides methods of treating (e.g., stabilizing, reducing, or eliminating one or more symptoms or stabilizing the subject's score on a head trauma scale) head trauma by administering a plasma kallikrein binding protein (e.g., a therapeutically effective amount of a plasma kallikrein binding protein) to a subject having or suspected of having head trauma. Additionally provided are methods of treating head trauma by administering a plasma kallikrein binding protein (e.g., a therapeutically effective amount of a plasma kallikrein binding protein) in combination with a second therapy, e.g., controlling elevated intracranial pressure (e.g., sedation, a paralytic, and/or cerebrospinal fluid diversion), decompressive craniectomy, barbiturate coma, hypertonic saline, and/or hypothermia. The disclosure also provides methods of preventing head trauma or a symptom thereof by administering a plasma kallikrein binding protein (e.g., a prophylactically effective amount of a plasma kallikrein binding protein) to a subject at risk of developing head trauma (e.g., a subject that will be participating in a dangerous activity or contact sport).

Scales useful for assessing head trauma and symptoms of head trauma include, e.g., the Glasgow Coma Scale (Teasdale and Jennett, Lancet 13; 2(7872):81-4 (1974)), as well as other assessment tools known in the art.

Guidance for the determination of the dosage that delivers a therapeutically effective amount of a plasma kallikrein binding protein may be obtained from animal models of head trauma, see, e.g., those described in Cernak, NeuroRx. 2(3): 410-422 (2005) and references cited therein.

Brain Edema

Brain edema (cerebral edema) is an excess accumulation of water in the intracellular and/or extracellular spaces of the brain. Types of brain edema include, e.g., vasogenic cerebral edema, cytotoxic cerebral edema, osmotic cerebral edema, and interstitial cerebral edema.

Vasogenic cerebral edema is due to a breakdown of tight endothelial junctions which make up the blood-brain barrier (BBB). This allows normally excluded intravascular proteins and fluid to penetrate into cerebral parenchymal extracellular space. Once plasma constituents cross the BBB, the edema spreads; this may be quite fast and widespread. As water enters white matter it moves extracellularly along fiber tracts and can also affect the gray matter. This type of edema is seen in response to trauma, tumors, focal inflammation, late stages of cerebral ischemia and hypertensive encephalopathy. Some of the mechanisms contributing to BBB dysfunction are: physical disruption by arterial hypertension or trauma, tumor-facilitated release of vasoactive and endothelial destructive compounds (e.g., arachidonic acid, excitatory neurotransmitters, eicosanoids, bradykinin, histamine and free radicals). Some of the special subcategories of vasogenic edema include: hydrostatic cerebral edema, cerebral edema from brain cancer, high altitude cerebral edema.

Cytotoxic cerebral edema is due to the derangement in cellular metabolism resulting in inadequate functioning of the sodium and potassium pump in the glial cell membrane. As a result there is cellular retention of sodium and water. Cytotoxic edema is seen with various intoxications (dinitrophenol, triethyltin, hexachlorophene, isoniazid), in Reye's syndrome, severe hypothermia, early ischemia, encephalopathy, early stroke or hypoxia, cardiac arrest, pseudotumor cerebri, and cerebral toxins.

Osmotic cerebral edema occurs when plasma is diluted by excessive water intake (or hyponatremia), syndrome of inappropriate antidiuretic hormone secretion (SIADH), hemodialysis, or rapid reduction of blood glucose in hyperosmolar hyperglycemic state (HHS), formerly hyperosmolar non-ketotic acidosis (HONK) and brain osmolality exceeds the serum osmolality creating an abnormal pressure.

Interstitial cerebral edema occurs in obstructive hydrocephalus. This form of edema is due to rupture of cerebralspinal fluid (CSF)-brain barrier resulting in trans-ependymal flow of CSF, which permits CSF to penetrate brain and spread in the extracellular space of white matter.

Symptoms of brain edema (e.g., peritumoral brain edema) include, e.g., headache, loss of coordination (ataxia), weakness, and decreasing levels of consciousness including disorientation, loss of memory, hallucinations, psychotic behavior, and coma.

Treatments for brain edema (e.g., peritumoral brain edema) include, e.g., medications (e.g. dexamethasone, mannitol, diuretics) and surgical decompression.

The disclosure provides methods of treating (e.g., stabilizing, reducing, or eliminating one or more symptoms of) brain edema (e.g., peritumoral brain edema) by administering a plasma kallikrein binding protein (e.g., a therapeutically effective amount of a plasma kallikrein binding protein) to a subject having or suspected of having brain edema (e.g., peritumoral brain edema). Additionally provided are methods of treating brain edema (e.g., peritumoral brain edema) by administering a plasma kallikrein binding protein (e.g., a therapeutically effective amount of a plasma kallikrein binding protein) in combination with a second therapy, e.g., a medication (e.g. dexamethasone, mannitol, and/or diuretics) and/or surgical decompression. The disclosure also provides methods of preventing brain edema or a symptom thereof by administering a plasma kallikrein binding protein (e.g., a prophylactically effective amount of a plasma kallikrein binding protein) to a subject at risk of developing brain edema (e.g., a subject that has been diagnosed with a brain tumor).

Guidance for the determination of the dosage that delivers a therapeutically effective amount of a plasma kallikrein binding protein may be obtained from animal models of brain edema, e.g., a rat model of cerebral embolism in which recirculation can be introduced in the ischemic area (Koizumi et al., Jpn J Stroke 8: 1-8 (1986)).

Sepsis

Sepsis is a serious medical condition that is characterized by a whole-body inflammatory state and the presence of a known or suspected infection. This immunological response may be caused by microbes in the blood, urine, lungs, skin, or other tissues and can lead to widespread activation of acute-phase proteins, affecting the complement system and the coagulation pathways, which then cause damage to the vasculature as well as to the organs. Different levels of sepsis include systemic inflammatory response syndrome (SIRS), sepsis (SIRS in response to a confirmed infectious process), severe sepsis (sepsis with organ dysfunction, hypoperfusion, or hypotension), and septic shock (sepsis with refractory arterial hypotension or hypoperfusion abnormalities in spite of adequate fluid resuscitation).

Symptoms of sepsis include, e.g., general symptoms related to the infection, acute inflammation present throughout the entire body, hypothermia or fever, tachycardia, tachypnea or hypocapnia due to hyperventilation, leukopenia, leukocytosis, bandemia, and organ (e.g., lung, brain, liver, kidney, and/or heart) dysfunction.

Treatments for sepsis include, e.g., antibiotics, vasopressor drugs, insulin, corticosteroids, drotrecogin alfa, surgical drainage of infected fluid collections, fluid replacement, and appropriate support for organ dysfunction (e.g., hemodialysis in kidney failure, mechanical ventilation in pulmonary dysfunction, transfusion of blood products, and drug and fluid therapy for circulatory failure). Early Goal Directed Therapy (EGDT), a systematic approach to resuscitation, can be used to treat severe sepsis and septic shock.

The disclosure provides methods of treating (e.g., stabilizing, reducing, or eliminating one or more symptoms or stabilizing the subject's score on a sepsis scale) sepsis by administering a plasma kallikrein binding protein (e.g., a therapeutically effective amount of a plasma kallikrein binding protein) to a subject having or suspected of having sepsis. Additionally provided are methods of treating sepsis by administering a plasma kallikrein binding protein (e.g., a therapeutically effective amount of a plasma kallikrein binding protein) in combination with a second therapy, e.g., an antibiotic, a vasopressor drug, insulin, a corticosteroid, drotrecogin alfa, surgical drainage of infected fluid collections, fluid replacement, an appropriate support for organ dysfunction (e.g., hemodialysis in kidney failure, mechanical ventilation in pulmonary dysfunction, transfusion of blood products, and/or drug and fluid therapy for circulatory failure), and/or an Early Goal Directed Therapy (EGDT). The disclosure also provides methods of preventing sepsis or a symptom thereof by administering a plasma kallikrein binding protein (e.g., a prophylactically effective amount of a plasma kallikrein binding protein) to a subject at risk of developing sepsis (e.g., a subject that has been diagnosed as having an infection).

Scales useful for assessing sepsis and symptoms of sepsis include, e.g., the Baltimore Sepsis Scale (Meek et al. *J Burn Care Rehabil.* 12(6):564-8 (1991)) as well as other assessment tools known in the art.

Guidance for the determination of the dosage that delivers a therapeutically effective amount of a plasma kallikrein binding protein may be obtained from animal models of sepsis, see, e.g., those described in U.S. Pat. No. 6,964,856, and Buras et al. Nat Rev Drug Discov. 4(10):854-65 (2005) and references cited therein.

Acute Middle Cerebral Artery (MCA) Ischemic Event (Stroke)

An acute middle cerebral artery (MCA) ischemic event (stroke) is the rapidly developing loss of brain function(s) due to disturbance in the blood supply to the brain due to ischemia (lack of glucose and oxygen supply) caused by thrombosis (e.g., venous thrombosis), embolism, or systemic hypoperfusion. As a result, the affected area of the brain is unable to function, leading to inability to move one or more limbs on one side of the body, inability to understand or formulate speech, or inability to see one side of the visual field. A stroke is a medical emergency and can cause permanent neurological damage, complications, and/or death.

Symptoms of acute middle cerebral artery (MCA) ischemic event (stroke) include, e.g., hemiplegia, decreased sensation and muscle weakness of the face, numbness, reduction in sensory or vibratory sensation, altered smell, taste, hearing or vision (total or partial), drooping of eyelid (ptosis) and weakness of ocular muscles, decreased reflexes, balance problems and nystagmus, altered breathing and heart rate, weakness in sternocleidomastoid muscle with inability to turn head to one side, weakness in tongue (inability to protrude and/or move from side to side), aphasia, apraxia, visual field defect, memory deficits, hemineglect, disorganized thinking, confusion, hypersexual gestures, anosognosia, trouble walking, altered movement coordination, and vertigo and/or disequilibrium.

Treatment for acute middle cerebral artery (MCA) ischemic event (stroke) includes, e.g., thrombolysis (e.g., tissue plasminogen activator (tPA)), thrombectomy, angioplasty and stenting, therapeutic hypothermia, and medications (e.g., aspirin, clopidogrel and dipyridamole).

The disclosure provides methods of treating (e.g., stabilizing, reducing, or eliminating one or more symptoms or stabilizing the subject's score on a stroke scale) acute middle cerebral artery (MCA) ischemic event (stroke) by administering a plasma kallikrein binding protein (e.g., a therapeutically effective amount of a plasma kallikrein binding protein) to a subject having or suspected of having acute middle cerebral artery (MCA) ischemic event (stroke). Additionally provided are methods of treating acute middle cerebral artery (MCA) ischemic event (stroke) by administering a plasma kallikrein binding protein (e.g., a therapeutically effective amount of a plasma kallikrein binding protein) in combination with a second therapy, e.g., thrombolysis (e.g., tissue plasminogen activator (tPA)), thrombectomy, angioplasty and stenting, therapeutic hypothermia, and/or a medication (e.g., aspirin, clopidogrel and dipyridamole). The disclosure also provides methods of preventing acute middle cerebral artery (MCA) ischemic event (stroke) or a symptom thereof by administering a plasma kallikrein binding protein (e.g., a prophylactically effective amount of a plasma kallikrein binding protein) to a subject at risk of developing acute middle cerebral artery (MCA) ischemic event (stroke) (e.g., a subject that has experienced systemic hypoperfusion).

Scales useful for assessing acute middle cerebral artery (MCA) ischemic event (stroke) and symptoms of acute middle cerebral artery (MCA) ischemic event (stroke) include, e.g., Oxford Community Stroke Project classification (OCSP, also known as the Bamford or Oxford classification) (Bamford et al., Lancet 337 (8756): 1521-6 (1991)), and TOAST (Trial of Org 10172 in Acute Stroke Treatment) (Adams et al., *Stroke* 24 (1): 35-41 (1993)).

Guidance for the determination of the dosage that delivers a therapeutically effective amount of a plasma kallikrein binding protein may be obtained from animal models of acute middle cerebral artery (MCA) ischemic event (stroke), see, e.g., those described in Beech et al., Brain Res 895: 18-24 (2001), Buchan et al., Stroke 23 (2): 273-9 (1992), Carmichael, NeuroRx 2: 396-409 (2005), Chen et al., Stroke 17 (4): 738-43 (1986), Dittmar et al., Stroke 34: 2252-7 (2003), Dittmar et al., J Neurosci Methods 156: 50 (2006), Gerriets et al., J Neurosci Methods 122: 201-11 (2003), Gerriets et al., Stroke 35: 2372-2377 (2004), Graham et al., Comp Med 54: 486-496 (2004), Koizumi et al., Jpn J Stroke 8: 1-8 (2004), Longa et al., Stroke 20 (1): 84-91 (1989), Mayzel-Oreg, Magn Reson Med 51: 1232-8 (2004), Schmid-Elsaesser et al., Stroke 29 (10): 2162-70 (1989), Tamura et al., J Cereb Blood Flow Metab 1: 53-60 (1981), Watson et al., Ann Neurol 17: 497-504 (1985), and Zhang et al., J Cereb Blood Flow Metab 17: 123-35 (1997).

Restenosis

Restenosis is the reoccurrence of stenosis, a narrowing of a blood vessel, leading to restricted blood flow. Restenosis usually pertains to an artery or other large blood vessel that has become narrowed, received treatment to clear the blockage such as angioplasty, and subsequently become renarrowed. It can be defined as a reduction in the circumference of the lumen of 50% or more, and had a high incidence rate (25-50%) in patients who had undergone balloon angioplasty, with the majority of patients needing further angioplasty within 6 months.

Treatments for restenosis include, e.g., additional angioplasty if restenosis occurs without a stent or at either end of a stent, repeated angioplasty and insertion of another stent inside the original if restenosis occurs within a stent, drug-eluted stents, brachytherapy, and intracoronary radiation.

The disclosure provides methods of treating (e.g., stabilizing, reducing, or eliminating one or more symptoms of) restenosis (e.g., after angioplasty) by administering a plasma kallikrein binding protein (e.g., a therapeutically effective amount of a plasma kallikrein binding protein) to a subject having or suspected of having restenosis (e.g., after angioplasty). Additionally provided are methods of treating restenosis (e.g., after angioplasty) by administering a plasma kallikrein binding protein (e.g., a therapeutically effective amount of a plasma kallikrein binding protein) in combination with a second therapy, e.g., angioplasty if restenosis occurs without a stent or at either end of a stent, repeated angioplasty and insertion of another stent inside the original if restenosis occurs within a stent, a drug-eluted stent, brachytherapy, and/or intracoronary radiation. The disclosure also provides methods of preventing restenosis or a symptom thereof by administering a plasma kallikrein binding protein (e.g., a prophylactically effective amount of a plasma kallikrein binding protein) to a subject at risk of developing restenosis (e.g., a subject that has had stenosis).

Guidance for the determination of the dosage that delivers a therapeutically effective amount of a plasma kallikrein binding protein may be obtained from animal models of restenosis, see, e.g., those described in U.S. Pat. Nos. 5,304,122 and 6,034,053, and Kantor et al., Cardiovasc Radiat Med. 1(1):48-54 (1999), and references cited therein.

Systemic Lupus Erythematosus Nephritis

Systemic lupus erythematosus nephritis is an inflammation of the kidney caused by systemic lupus erythematosus (SLE), a chronic autoimmune connective tissue disease. SLE can be associated with vasculitis which are disorders characterized by inflammatory destruction of blood vessels.

Symptoms of systemic lupus erythematosus nephritis include, e.g., general symptoms of kidney disease, weight gain, high blood pressure, darker foamy urine, and swelling around the eyes, legs, ankles or fingers.

Treatments for systemic lupus erythematosus nephritis include, e.g., steroid therapy (e.g., corticosteroids), chemotherapy (e.g., cyclophosphamide, azathioprine, mycophenolate mofetil, or cyclosporine), and immunosuppressant agents (e.g., mycophenolate mofetil and intravenous cyclophosphamide).

The disclosure provides methods of treating (e.g., stabilizing, reducing, or eliminating one or more symptoms or stabilizing the subject's score on a lupus scale) systemic lupus erythematosus nephritis by administering a plasma kallikrein binding protein (e.g., a therapeutically effective amount of a plasma kallikrein binding protein) to a subject having or suspected of having systemic lupus erythematosus nephritis. Additionally provided are methods of treating systemic lupus erythematosus nephritis by administering a plasma kallikrein binding protein (e.g., a therapeutically effective amount of a plasma kallikrein binding protein) in combination with a second therapy, e.g., steroid therapy (e.g., a corticosteroid), chemotherapy (e.g., cyclophosphamide, azathioprine, mycophenolate mofetil, and/or cyclosporine), and/or an immunosuppressant agent (e.g., mycophenolate mofetil and/or intravenous cyclophosphamide). The disclosure also provides methods of preventing systemic lupus erythematosus nephritis or a symptom thereof by administering a plasma kallikrein binding protein (e.g., a prophylactically effective amount of a plasma kallikrein binding protein) to a subject at risk of developing systemic lupus erythematosus nephritis (e.g., a subject that has been diagnosed with lupus or a subject having a family member with lupus or a genetic predisposition thereto).

Scales useful for assessing systemic lupus erythematosus nephritis and symptoms of systemic lupus erythematosus nephritis include, e.g., World Health Organization (WHO) classification based on the biopsy (Weening et al., *J. Am. Soc. Nephrol.* 15 (2): 241-50 (2004)) as well as other assessment tools known in the art.

Guidance for the determination of the dosage that delivers a therapeutically effective amount of a plasma kallikrein binding protein may be obtained from animal models of systemic lupus erythematosus nephritis, see, e.g., those described in U.S. Pat. No. 7,265,261, Peng, Methods Mol. Med. 102:227-72 (2004), and references cited therein.

Burn Injury and Wound Healing

A burn injury is a type of injury that may be caused by heat, electricity, chemicals, light, radiation, or friction. Muscle, bone, blood vessel, dermal and epidermal tissue can all be damaged with subsequent pain due to profound injury to nerves. Depending on the location affected and the degree of severity, a burn victim may experience a wide number of potentially fatal complications including shock, infection, electrolyte imbalance and respiratory distress. In burn injuries, the damage to epidermis and dermal elements is the result of several key insults which can be divided into initial (e.g., heat injury, inflammatory mediator injury, ischemia induced injury) and delayed insults. Excess heat causes rapid protein denaturation and cell damage. Much of the tissue damage, e.g., in the perfused subsurface burn, can be caused by toxic mediators of inflammation (e.g., oxidants and/or proteases) which are activated with the burn. Consumption of wound oxygen by neutrophils can lead to tissue hypoxia. Instant surface vascular thrombosis occurs along with cell death from the heat insult and causes ischemia and further tissue damage. Delayed injury after the initial heat and mediator damage includes, e.g., inflammation caused by neurotic tissue, bacteria on surface, caustic topical agents, and surface exudate; and continued damage to viable cells and new tissue growth by excess wound proteolytic activity and oxidant release.

Treatments of burn injury include, e.g., intravenous fluids, dressings, pain management (e.g., analgesics (e.g., ibuprofen and acetaminophen), narcotics, and local anesthetics), inflammatory mediator inhibitors, and antibiotics.

The disclosure provides methods of treating (e.g., stabilizing, reducing, or eliminating one or more symptoms or stabilizing the subject's score on a burn scale) a burn injury and/or promoting wound healing by administering a plasma kallikrein binding protein (e.g., a therapeutically effective amount of a plasma kallikrein binding protein) to a subject having or suspected of having a burn injury. Additionally provided are methods of treating a burn injury by administering a plasma kallikrein binding protein (e.g., a therapeutically effective amount of a plasma kallikrein binding protein) in combination with a second therapy, e.g., intravenous fluid, a dressing, pain management (e.g., an analgesic (e.g., ibuprofen and acetaminophen), a narcotic, and a local anesthetic), an inflammatory mediator inhibitor, and an antibiotic. The disclosure also provides methods of preventing burn injuries or a symptom thereof by administering a plasma kallikrein binding protein (e.g., a prophylactically effective amount of a plasma kallikrein binding protein) to a subject at risk of developing burn injuries (e.g., a subject whose occupation creates a risk of a burn injury, e.g., firefighter or cook).

Scales useful for assessing burns and symptoms of burns include, e.g., burn scales by degrees, by thickness, and by total body surface area (TBSA) (Meek et al. *J Burn Care Rehabil.* 12(6):564-8 (1991)) as well as other assessment tools known in the art.

Guidance for the determination of the dosage that delivers a therapeutically effective amount of a plasma kallikrein binding protein may be obtained from animal models of burn, such as a porcine burn model (Singer and McClain, Methods Mol. Med. 78:107-19 (2003), a sheep model of thermal injury (Jonkam et al., Shock, 28:704-709 (2007)), a rabbit model of thermal injury (Nwariaku et al., Burns, 22:324-327 (1996)), and a mouse model of burn wounding (Stevenson et al., Methods Mol. Med. 78:95-105 (2003)).

Combination Therapies

A plasma kallikrein binding protein described herein, e.g., an anti-plasma kallikrein antibody, e.g., an anti-plasma kallikrein Fab or IgG, can be administered in combination with one or more of the other therapies for treating a disease or condition associated with plasma kallikrein activity, e.g., a disease or condition described herein. For example, a plasma kallikrein binding protein can be used therapeutically or prophylactically with surgery, another anti-plasma kallikrein Fab or IgG (e.g., another Fab or IgG described herein), another plasma kallikrein inhibitor, a peptide inhibitor, or small molecule inhibitor. Examples of plasma kallikrein inhibitors that can be used in combination therapy with a plasma kallikrein binding protein described herein include plasma kallikrein inhibitors described in, e.g., WO 95/21601 or WO 2003/103475.

One or more plasma kallikrein inhibitors can be used in combination with one or more plasma kallikrein binding proteins described herein. For example, the combination can result in a lower dose of the inhibitor being needed, such that side effects are reduced.

A plasma kallikrein binding protein described herein can be administered in combination with one or more current therapies for treating a plasma kallikrein associated disease or condition, including, but not limited to the current therapies for treating the disorder, e.g., a current therapy for rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, head trauma or peri-tumor brain edema, sepsis, acute middle cerebral artery (MCA) ischemic event (stroke), restenosis (e.g., after angioplasty), systemic lupus erythematosis nephritis, burn injury, or wound healing. For example, pKal inhibition is a novel mechanism of treating disease and therefore could provide effects that are synergistic or additive with other therapeutics. For example, a protein described herein that inhibits plasma kallikrein or that inhibits a downstream event of plasma kallikrein activity can also be used in combination with another treatment for a plasma kallikrein associated disease, such as surgery or administration of a second agent, e.g., as described herein. For example, the second agent can include ecallantide, a C1 esterase inhibitor (e.g., CINRYZE™), aprotinin (TRASYLOL®), a bradykinin B2 receptor inhibitor (e.g., icatibant (FIRAZYR®)).

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order. Sequential administrations are administrations that are given at different times. The time between administration of the one agent and another agent can be minutes, hours, days, or weeks. The use of a plasma kallikrein binding protein described herein can also be used to reduce the dosage of another therapy, e.g., to reduce the side effects associated with another agent that is being administered. Accordingly, a combination can include administering a second agent at a dosage at least 10, 20, 30, or 50% lower than would be used in the absence of the plasma kallikrein binding protein.

The second agent or therapy can also be another agent for a plasma kallikrein associated therapy. Non-limiting examples of another treatment for a plasma kallikrein associated disease or condition include, e.g., ecallantide, a C1 esterase inhibitor (e.g., CINRYZE™), aprotinin (TRASYLOL®), a bradykinin B2 receptor inhibitor (e.g., icatibant (FIRAZYR®)) or a second binding protein described herein.

A combination therapy can include administering an agent that reduces the side effects of other therapies. The agent can be an agent that reduces the side effects of a plasma kallikrein associated disease treatment. For example, for inflammatory diseases, a pKal inhibitor could be steroid sparring. Also, there could be synergism with a TNF-alpha inhibitor for treating inflammation or a VEGF blocker for treating cancer and/or angiogenesis.

Diagnostic Uses

A protein that binds to plasma kallikrein described herein can have in vitro and in vivo diagnostic utilities. A plasma kallikrein binding protein described herein (e.g., a protein that binds or binds and inhibits plasma kallikrein) can be used, e.g., for in vivo imaging, e.g., during a course of treatment for a disease or condition in which plasma kallikrein is active, e.g., a disease or condition described herein, or in diagnosing a disease or condition described herein.

In one aspect, the disclosure provides a diagnostic method for detecting the presence of plasma kallikrein, in vitro or in vivo (e.g., in vivo imaging in a subject). The method can include localizing plasma kallikrein within a subject or within a sample from a subject. With respect to sample evaluation, the method can include, for example: (i) contacting a sample with plasma kallikrein binding protein; and (ii) detecting the location of the plasma kallikrein binding protein in the sample.

A plasma kallikrein binding protein can also be used to determine the qualitative or quantitative level of expression of plasma kallikrein in a sample. The method can also include contacting a reference sample (e.g., a control sample, e.g., a negative control) with the binding protein, and determining a corresponding assessment of the reference sample. A difference (e.g., increase), e.g., a statistically significant difference, in the formation of the complex in the sample or subject relative to the control sample or subject can be indicative of the presence of plasma kallikrein in the sample. In one embodiment, the plasma kallikrein binding protein does not cross react with another kallikrein protein, such as tissue kallikrein and/or with plasma prekallikrein. E.g., the binding protein binds to another kallikrein protein or to prekallikrein 5- to 10-fold less well (or even less well) than it binds to plasma kallikrein. For example, the binding protein can bind to plasma kallikrein with a KD of ~10-50 pM, whereas it binds to tissue kallikrein and/or prekallikrein at ~10 nM.

The plasma kallikrein binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the plasma kallikrein binding protein and plasma kallikrein can be detected by evaluating the binding protein bound to the plasma kallikrein or unbound binding protein. Conventional detection assays can be used, e.g., an enzyme-linked immunosorbent assays (ELISA), a radioimmunoassay (RIA) or tissue immunohistochemistry. Further to labeling the plasma kallikrein binding protein, the presence of plasma kallikrein can be assayed in a sample by a competition immunoassay utilizing standards labeled with a detectable substance and an unlabeled plasma kallikrein binding protein. In one example of this assay, the biological sample, the labeled standards, and the plasma kallikrein binding protein are combined and the amount of labeled standard bound to the unlabeled binding protein is determined. The amount of plasma kallikrein in the sample is inversely proportional to the amount of labeled standard bound to the plasma kallikrein binding protein.

Fluorophore and chromophore labeled proteins can be prepared. Because antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer, 1968, Science 162:526 and Brand, L. et al., 1972, Annu. Rev. Biochem. 41:843-868. The proteins can be labeled with fluorescent chromophore groups by conventional procedures such as those disclosed in U.S. Pat. Nos. 3,940,475, 4,289,747, and 4,376,110. One group of fluorescers having a number of the desirable properties described above is the xanthene dyes, which include the fluoresceins and rhodamines. Another group of fluorescent compounds are the naphthylamines. Once labeled with a fluorophore or chromophore, the protein can be used to detect the presence or localization of the plasma kallikrein in a sample, e.g., using fluorescent microscopy (such as confocal or deconvolution microscopy).

Histological Analysis.

Immunohistochemistry can be performed using the proteins described herein. For example, in the case of an antibody, the antibody can be synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation.

Of course, the antibody (or other polypeptide or peptide) can be unlabeled at the time of binding. After binding and washing, the antibody is labeled in order to render it detectable.

Protein Arrays.

The plasma kallikrein binding protein can also be immobilized on a protein array. The protein array can be used as a diagnostic tool, e.g., to screen medical samples (such as isolated cells, blood, sera, biopsies, and the like). Of course, the protein array can also include other binding proteins, e.g., that bind to plasma kallikrein or to other target molecules.

Methods of producing polypeptide arrays are described, e.g., in De Wildt et al., 2000, Nat. Biotechnol. 18:989-994; Lueking et al., 1999, Anal. Biochem. 270:103-111; Ge, 2000, Nucleic Acids Res. 28, e3, I-VII; MacBeath and Schreiber, 2000, Science 289:1760-1763; WO 01/40803 and WO 99/51773A1. Polypeptides for the array can be spotted at high speed, e.g., using commercially available robotic apparati, e.g., from Genetic MicroSystems or BioRobotics. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the proteins can be grown on a filter in an arrayed format. Polypeptide production is induced, and the expressed polypeptides are immobilized to the filter at the location of the cell. A protein array can be contacted with a labeled target to determine the extent of binding of the target to each immobilized polypeptide. Information about the extent of binding at each address of the array can be stored as a profile, e.g., in a computer database. The protein array can be produced in replicates and used to compare binding profiles, e.g., of a target and a non-target.

FACS (Fluorescence Activated Cell Sorting).

The plasma kallikrein binding protein can be used to label cells, e.g., cells in a sample (e.g., a patient sample). The binding protein is also attached (or attachable) to a fluorescent compound. The cells can then be sorted using fluorescence activated cell sorter (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence. The amount of label bound to each cell can be quantified and analyzed to characterize the sample.

The sorter can also deflect the cell and separate cells bound by the binding protein from those cells not bound by the binding protein. The separated cells can be cultured and/or characterized.

In vivo Imaging.

Also featured is a method for detecting the presence of plasma kallikrein expressing tissues in vivo. The method includes (i) administering to a subject (e.g., a patient having, e.g., a plasma kallikrein associated disease or condition) an anti-plasma kallikrein antibody, conjugated to a detectable marker; (ii) exposing the subject to a means for detecting said detectable marker to the plasma kallikrein expressing tissues or cells. For example, the subject is imaged, e.g., by NMR or other tomographic means.

Examples of labels useful for diagnostic imaging include radiolabels such as $^{131}$I, $^{111}$In, $^{123}$I, $^{99m}$Tc, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short range radiation emitters, such as isotopes detectable by short range detector probes can also be employed. The protein can be labeled with such reagents; for example, see Wensel and Meares, 1983, Radioimmunoimaging and Radioimmunotherapy, Elsevier, New York for techniques relating to the radiolabeling of antibodies and D. Colcher et al., 1986, *Meth. Enzymol.* 121: 802-816.

The binding protein can be labeled with a radioactive isotope (such as $^{14}$C, $^{3}$H, $^{35}$S, $^{125}$I, $^{32}$P, $^{131}$I). A radiolabeled binding protein can be used for diagnostic tests, e.g., an in vitro assay. The specific activity of a isotopically-labeled binding protein depends upon the half life, the isotopic purity of the radioactive label, and how the label is incorporated into the antibody.

In the case of a radiolabeled binding protein, the binding protein is administered to the patient, is localized to cells bearing the antigen with which the binding protein reacts, and is detected or "imaged" in vivo using known techniques such as radionuclear scanning using e.g., a gamma camera or emission tomography. See e.g., A. R. Bradwell et al., "Developments in Antibody Imaging", Monoclonal Antibodies for Cancer Detection and Therapy, R. W. Baldwin et al., (eds.), pp 65 85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents.

Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments are used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates) can be used to attach (and reduce toxicity) of some paramagnetic substances (e.g., $Fe^{+3}$, $Mn^{+2}$, $Gd^{+3}$). Other agents can be in the form of particles, e.g., less than 10 mm to about 10 nM in diameter). Particles can have ferromagnetic, antiferromagnetic, or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like.

The plasma kallikrein binding protein can also be labeled with an indicating group containing of the NMR active $^{19}$F atom, or a plurality of such atoms inasmuch as (i) substantially all of naturally abundant fluorine atoms are the $^{19}$F isotope and, thus, substantially all fluorine containing compounds are NMR active; (ii) many chemically active polyfluorinated compounds such as trifluoracetic anhydride are commercially available at relatively low cost; and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett, 1982, *Sci. Am.* 246:78 88 to locate and image tissues expressing plasma kallikrein.

The following examples provide further illustration and are not limiting.

EXAMPLES

Example 1

We have discovered several antibody inhibitors and binders of plasma kallikrein (pKal). The most potent of these have been further characterized and shown to have apparent inhibition constants ($K_{i,app}$)<10 nM, to be specific pKal inhibitors with respect to other tested serine proteases, and to not bind prekallikrein. Amino acid sequences of the CDRs for the inhibitors and the binders are shown in Tables 1 and 2, respectively.

TABLE 1

CDR Amino Acid Sequences, ELISA Signal, and Apparent Inhibition Constant of Antibody Inhibitors of PKal (SEQ ID NOs: 8-223)

| Initial Name | Human pKal ELISA (T/B) | Human pKal (Ki, app nM) | LV-CDR1 (SEQ ID NOs: 8-43) | LV-CDR2 (SEQ ID NOs: 44-79) | LV-CDR3 (SEQ ID NOs: 80-115) | HV-CDR1 (SEQ ID NOs: 116-151) | HV-CDR2 (SEQ ID NOs: 152-187) | HV-CDR3 (SEQ ID NOs: 188-223) |
|---|---|---|---|---|---|---|---|---|
| M6-D09 | 39.9 | 5.9 | RASQSIRNYLN | AASTLQS | QQLSGYPHT | FYYMV | VIYPSGGITVYADSVKG | DKWAVMPPYYYYAMDV |
| M7-B04 | 4.1 | 54 | TGTNSDVGNYNLVS | EVNKRPS | CSYAGNRNFYV | WYSMV | SISPSGGLTNYADSVKG | HTAARPFYYYYMDV |
| M7-E07 | 45.7 | 36 | SGDKLGDKYAC | QDSKRPS | QAWDSSTGV | WYLMI | YIYPSGGFTYYADSVKG | TEGPLSWGYGMDV |

TABLE 1-continued

CDR Amino Acid Sequences, ELISA Signal, and Apparent Inhibition Constant of Antibody
Inhibitors of PKal (SEQ ID NOs: 8-223)

| Initial Name | Human pKal ELISA (T/B) | Human pKal (Ki, app nM) | LV-CDR1 (SEQ ID NOs: 8-43) | LV-CDR2 (SEQ ID NOs: 44-79) | LV-CDR3 (SEQ ID NOs: 80-115) | HV-CDR1 (SEQ ID NOs: 116-151) | HV-CDR2 (SEQ ID NOs: 152-187) | HV-CDR3 (SEQ ID NOs: 188-223) |
|---|---|---|---|---|---|---|---|---|
| M8-A09 | 5.4 | 105 | SGDKLGNKYAY | QDNNRPS | QAWDSRTVV | TYFMLSIYPSGGNTVYADS-VKG | | AASPVRNYYYGMDV |
| M10-F10 | 39.2 | <100 nM | RASQSISVYLN | GASNLQF | QQTFSLFT | FYNMNSISPSGGETNYADS-VKG | | GGGAYRNNWWGGFDI |
| M10-H05 | 42.2 | 18 | RASQSVSSYLA | GASSRAT | QQYGSSPFT | PYNMYSIRPSGGGTVYADS-VKG | | GFIAARWYYFDY |
| M12-D05 | 48.5 | 5.2 | SGDQLGDKYVG | QDTKRPS | QAWDTSTAG | WYTMVRIYPSGGWTKYADS-VKG | | EGLLWFGENAFDI |
| M27-E05 | 41.3 | 16 | SGDKLGDKYAC | QDSKRPS | QAWDSSTGV | WYLMIYIYPSGGFTYYADS-VKG | | TEGPLSWGYGMDV |
| M28-B11 | 33.3 | 5.5 | SGDQLGDKYVG | QDTKRPS | QAWDTSTAG | WYTMVRIYPSGGWTKYADS-VKG | | EGLLWFGENAFDI |
| M29-D09 | 47.5 | 0.7 | SGNKLGDKYVA | QDTKRPS | QAWDSSIVI | WYTMVYIYPSGGATFYADS-VKG | | GSYDYIWGFYSDH |
| M29-E09 | 28.8 | 11 | SGDNLGNKYNS | QDTKRPS | QAWDGNVV | WYEMGSIYSSGGGTMYADS-VKG | | NPQYSGYDRSLSDGAFDI |
| M35-G04 | 11.1 | 2.9 | RASQSVSSYLA | DASNRAT | QQRSNWPRGFT | YYHMSVISPSGGSTKYADS-VKG | | GGSSDYAWGSYRRPYYFDY |
| M38-F02 | 33.5 | 14 | SGEKLGDKYVS | EDSRRPS | QAWDSSTAI | YYMMVYIYSSGGHTVYADS-VKG | | DLFLYDFWSKGAFDI |
| M41-A11 | 28.0 | 13 | SGDKLGDKYTS | QDIKRPS | QAWDSPNARV | HYRMSSIYPSGGRTVYADS-VKG | | DKFEWRLLFRGIGNDAFDI |
| M73-D06 | 4.0 | <100 nM | SGSSSNIGSNTVS | NDHRRPS | SAWDDSLNGVV | RYEMYSISSSGGPTAYADS-VKG | | GTPKWELLLRSIYIENAFDI |
| M76-D01 | 11.2 | <100 nM | RSSQSLSDDGNTYLD | TLSYRAS | MQGTHWPPT | FYAMHGIVPSGGRTHYADS-VKG | | DSSGSPNPLFDY |
| M110-C12 | 2.4 | <100 nM | RSSLSLLHSNGYNYLD | LSSTRAS | MQPLETPPT | YYEMDGISSSGGHTAYADS-VKG | | ERRSSSRARYYYGMDV |
| M137-E12 | 4.5 | 79 | SGNNSNFGSNTVT | SDSRRPS | AAWDDSLNGV | DYRMQVIVPSGGNTMYADS-VKG | | GGPGSSIAARRAPTGYYGMDV |
| M142-H08 | 29.9 | 0.2 | RASQPIDNYLN | AASRLQS | QQSYTVPYT | AYSMIYIRPSGGRTTYADS-VKG | | GGLLLWFRELKSNYFDY |
| M145-D01 | 6.2 | 1.1 | RASQSVSSYLA | DASNRAT | QQRSNWPRGFT | YYHMSVISPSGGSTKYADS-VKG | | GGSSDYAWGSYRRPYYFDY |
| M145-D11 | 40.0 | 0.79 | SGDKLGDKYTS | QDIKRPS | QAWDSPNARV | HYRMSSIYPSGGRTVYADS-VKG | | DKFEWRLLFRGIGNDAFDI |
| M146-E12 | 49.6 | 2.2 | RASGDIGNALG | DASTLQS | LQGYNYPRT | RYIMHSISPSGGLTSYADS-VKG | | EFENAYHYYYGMDV |
| M152-A12 | 19. | <100 nM | RASQSISSYLS | AASSLQS | QQSISIPRT | PYFMGGIGPSGGSTTYADS-VKG | | EGPPYSSGWYRGLRQYHFDY |
| M160-G12 | 38.3 | 17 | RASQGISSYLA | AASTLQS | QQLNSYPLT | HYLMTYISPSGGHTIYADS-VKG | | VARGIAARSRTSYFDY |
| M161-C11 | 41.8 | 0.3 | SGDKLGDKYVS | QDTKRPS | QAWDSSTYV | DYAMKSISSSGGVTQYADS-VKG | | EEDYSSSWYSRRFDYYYGMDV |
| M162-A04 | 11.4 | 4.8 | RASQSISSWLA | KASTLES | QQYNTYWT | HYIMMGIYSSGGITVYADS-VKG | | RRTGIPRRDAFDI |
| X67-B03 | nd | 2.1 | RASQPIDNYLN | AASRLQS | QQSYTVPYT | AYSMIYIRPSGGRTTYADS-VKG | | GGLLLWSRELKSNYFDY |
| X67-C03 | nd | 0.7 | RASQPIDNYLN | AASRLQS | QQSYTVPYT | AYSMIYIRPSGGRTTYADS-VKG | | GGLLLWFMELKSNYFDY |
| X67-C09 | nd | 8.6 | RASQPIDNYLN | AASRLQS | QQSYTVPYT | AYSMIYIRPSGGRTTYADS-VKG | | GGLLLWGRELKSNYFDY |
| X67-D03 | nd | 0.1 | RASQPIDNYLN | AASRLQS | QQSYTVPYT | AYSMIYIRPSGGRTTYADS-VKG | | GGLLLWNRELKSNYFDY |
| X67-E04 | nd | 1.3 | RASQPIDNYLN | AASRLQS | QQSYTVPYT | AYSMIYIRPSGGRTTYADS-VKG | | GGLLLWDRELKSNYFDY |
| X67-F01 | nd | 0.9 | RASQPIDNYLN | AASRLQS | QQSYTVPYT | AYSMIYIRPSGGRTTYADS-VKG | | GGLLLWQRELKSNYFDY |
| X67-F10 | nd | 1.3 | RASQPIDNYLN | AASRLQF | QQSYTVPYT | AYSMIYIRPSGGRTTYADS-VKG | | GGLLLWTRELKSNYFDY |
| X67-G04 | nd | 0.35 | RASQPIDNYLN | AASRLQS | QQSYTVPYT | AYSMIYIRPSGGRTTYADS-VKG | | GGLLLWARELKSNYFDY |
| X67-H04 | nd | 3.6 | RASQPIDNYLN | AASRLQS | QQSYTVPYT | AYSMIYIRPSGGRTTYADS-VKG | | GGLLLWERELKSNYFDY |
| X81-E01 | nd | 0.2 | RTSQFVNSNYLA | GASSRAT | QQSSRTPWT | HYLMTYISPSGGHTIYADS-VKG | | VARGIAARSRTSYFDY |

Abbreviations used:
"T/B" is the ELISA signal obtained using of the "target" (biotinylated plasma kallikrein) divided by the ELISA signal of the "background" (streptavidin); both of which were coated on microtiter plates.
"nd" is not determined.
The symbol "q" refers to the amber suppressible stop codon (TAG), which is translated as glutamine (Q) in strains of *E. coli* such as the TG1 cells that were used to express the Fab fragments.

Amino Acid Sequences of Light Chain (LC) and Heavy Chain (HC) Variable Domain of pKal Antibody Inhibitors are Shown Below (SEQ ID NOs:224-293 Numbered in Order from Top to Bottom).

```
M6-D09                 LC
QDIQMTQSPS SLSASVGDRV TITCRASQSI RNYLNWYQQK PGKAPNLLIY AASTLQSGVP    60

ARFSGSGSGT DFTLTISSLQ PEDFATYYCQ QLSGYPHTFG QGTKLEIK                108

M6-D09                 HC
EVQLLESGGG LVQPGGSLRL SCAASGFTFS FYYMVWVRQA PGKGLEWVSV IYPSGGITVY    60

ADSVKGRFTI SRDNSKNTLY LQMNSLRAED TAVYYCARDK WAVMPPYYYY AMDVWGQGTT   120

VTVSSASTKG PSVFPLAPSS KS                                           142

M7-B04                 LC
QSALTQPASV SGSPGQSITI SCTGTNSDVG NYNLVSWYQQ HPGEAPKLLI YEVNKRPSGV    60

SNRFSGSKSG NTASLTISGL QAEDEADYLC CSYAGNRNFY VFGAGTKVTV L            111

M7-B04                 HC
EVQLLESGGG LVQPGGSLRL SCAASGFTFS WYSMVWVRQA PGKGLEWVSS ISPSGGLTNY    60

ADSVKGRFTI SRDNSKNTLY LQMNSLRAED TAVYYCARHT AARPFYYYYM DVWGKGTTVT   120

VSSASTKGPS VFPLAPSSKS                                              140

M7-E07                 LC
QSELTQPPSV SVSPGQTASI TCSGDKLGDK YACWYQQKPG QSPVLVIYQD SKRPSGIPER    60

FSGSNSGNTA TLTISGTQAM DEADYYCQAW DSSTGVFGGG TKLTVL                  106

M7-E07                 HC
EVQLLESGGG LVQPGGSLRL SCAASGFTFS WYLMIWVRQA PGKGLEWVSY IYPSGGFTYY    60

ADSVKGRFTI SRDNSKNTLY LQMNSLRAED MAVYYCARTE GPLSWGYGMD VWGQGTTVTV   120

SSASTKGPSV FPLAPSSKS                                               139

M8-A09                 LC
QCELTQPPSE SVSPGQTANI TCSGDKLGNK YAYWYQQKPG QSPVLVIYQD NNRPSGIPER    60

FSGSNSGNTA TLTISGTQAI DEANYYCQAW DSRTVVFGGG TKLTVL                  106

M8-A09                 HC
EVQLLESGGG LVQPGGSLRL SCAASGFTFS TYFMLWVRQA PGKGLEWVSS IYPSGGNTVY    60

ADSVKGRFTI SRDNSKNTLY LQMNSLRAED TAVYYCARAA SPVRNYYYYG MDVWGQGTTV   120

TVSSASTKGP SVFPLAPSSK S                                            141

M10-F10                LC
QDIQMTQSPS SLSASVGDRV TITCRASQSI SVYLNWYQHK PGKAPKLLIY GASNLQFGVP    60

SRFSGSGYGT DFTLTISSLQ PEDFATYHCQ QTFSLFTFGG GTKVEIK                 107

M10-F10                HC
EVQLLESGGG LVQPGGSLRL SCAASGFTFS FYNMNWVRQA PGKGLEWVSS ISPSGGETNY    60

ADSVKGRFTI SRDNSKNTLY LQMNSLRAED TAVYYCARGG GAYRNNWWGG FDIWGLGTMV   120

TVSSASTKGP SVFPLAPSSK S                                            141

M10-H05                LC
QDIQMTQSPG TLSLSPGERA TLSCRASQSV SSSYLAWYQQ KPGQAPRLLI YGASSRATGI    60

PDRFSGSGSG TDFTLTISRL EPEDFAVYYC QQYGSSPFTF GPGTKVDIK               109

M10-H05                HC
EVQLLESGGG LVQPGGSLRL SCAASGFTFS PYNMYWVRQA PGKGLEWVSS IRPSGGGTVY    60

ADSVKGRFTI SRDNSKNTLY LQMNSLRAED TAVYYCAGGF IAARWYYFDY WGQGTLVTVS   120

SASTKGPSVF PLAPSSKS                                                138
```

```
M12-D05              LC
QSVLTQPPSV SVSPGQTATI TCSGDQLGDK YVGWYQQKPG QSPILVIYQD TKRPSGIPER      60

FSGSNSGNTA TLTISGTHTV DEAHYYCQAW DTSTAGFGGG TKLTVL                     106

M12-D05              HC
EVQLLESGGG LVQPGGSLRL SCAASGFTFS WYTMVWVRQA PGKGLEWVSR IYPSGGWTKY      60

ADSVKGRFTI SRDNSKNTLY LQMNSLRAED TATYYCAREG LLWFGENAFD IWGQGTMVTV      120

SSASTKGPSV FPLAPSSKS                                                   139

M27-E05              LC
QSELTQPPSV SVSPGQTASI TCSGDKLGDK YACWYQQKPG QSPVLVIYQD SKRPSGIPER      60

FSGSNSGNTA TLTISGTQAM DEADYYCQAW DSSTGVFGGG TKLTVL                     106

M27-E05              HC
EVQLLESGGG LVQPGGSLRL SCAASGFTFS WYLMIWVRQA PGKGLEWVSY IYPSGGFTYY      60

ADSVKGRFTI SRDNSKNTLY LQMNSLRAED MAVYYCARTE GPLSWGYGMD VWGQGTTVTV      120

SSASTKGPSV FPLAPSSKS                                                   139

M28-B11              LC
QSVLTQPPSV SVSPGQTATI TCSGDQLGDK YVGWYQQKPG QSPILVIYQD TKRPSGIPER      60

FSGSNSGNTA TLTISGTHTV DEAHYYCQAW DTSTAGFGGG TKLTVL                     106

M28-B11              HC
EVQLLESGGG LVQPGGSLRL SCAASGFTFS WYTMVWVRQA PGKGLEWVSR IYPSGGWTKY      60

ADSVKGRFTI SRDNSKNTLY LQMNSLRAED TATYYCAREG LLWFGENAFD IWGQGTMVTV      120

SSASTKGPSV FPLAPSSKS                                                   139

M29-D09              LC
QSALTQPPTV SVSPGQTARI TCSGNKLGDK YVAWYQQKPG QSPMLVIYQD TKRPSRVSER      60

FSGSNSANTA TLSISGTQAL DEADYYCQAW DSSIVIFGGG TRLTVL                     106

M29-D09              HC
EVQLLESGGG LVQPGGSLRL SCAASGFTFS WYTMVWVRQA PGKGLEWVSY IYPSGGATFY      60

ADSVKGRFTI SRDNSKNTLY LQMNSLRAED TAVYYCAMGS YDYIWGFYSD HWGQGTLVTV      120

SSASTKGPSV FPLAPSSKS                                                   139

M29-E09              LC
QYELTQPPSV SVSPGQTATI TCSGDNLGNK YNSWYQQKPG QSPLLVIYQD TKRPSAIPER      60

FSGSNSGNTA TLTISGTQAM DEADYYCQAW DGNVVFGGGT KLTVL                      105

M29-E09              HC
EVQLLESGGG LVQPGGSLRL SCAASGFTFS WYEMGWVRQA PGKGLEWVSS IYSSGGGTMY      60

ADSVKGRFTI SRDNSKNTLY LQMNSLRAED TAVYYCARNP QYSGYDRSLS DGAFDIWGQG      120

TMVTVSSAST KGPSVFPLAP SSKS                                             144

M35-G04              LC
QDIQMTQSPA TLSLSPGERA TLSCRASQSV SSYLAWYQQK PGQAPRLLIY DASNRATGIP      60

ARFSGSGSGT DFTLTISSLE PEDFAVYYCQ QRSNWPRGFT FGPGTKVDIK                 110

M35-G04              HC
EVQLLESGGG LVQPGGSLRL SCAASGFTFS YYHMSWVRQA PGKGLEWVSV ISPSGGSTKY      60

ADSVKGRFTI SRDNSKNTLY LQMNSLRAED TAVYYCARGG SSDYAWGSYR RPYYFDYWGQ      120

GTLVTVSSAS TKGPSVFPLA PSSKS                                            145

M38-F02              LC
QSVLTQPPSV SVSPGQTASI TCSGEKLGDK YVSWYQQKPG QSPSLVICED SRRPSGIPER      60

FSGSNSGNTA TLTISGAQPM DEADYYCQAW DSSTAIFGPG TKVTVL                     106

M38-F02              HC
EVQLLESGGG LVQPGGSLRL SCAASGFTFS YYMMVWVRQA PGKGLEWVSY IYSSGGHTVY      60
```

-continued

```
ADSVKGRFTI SRDNSKNTLY LQMNSLRAED TAVYYCARDL FLYDFWSKGA FDIWGQGTMV      120
TVSSASTKGP SVFPLAPSSK S                                                141

M41-A11              LC
QSVLTQPPSV SVSPGQTASI TCSGDKLGDK YTSWYQQRPG QSPVLVIYQD IKRPSGIPER      60
FSGSNSGNTA TLTISGTQAM DEADYYCQAW DSPNARVFGS GTKVTVL                    107

M41-A11              HC
EVQLLESGGG LVQPGGSLRL SCAASGFTFS HYRMSWVRQA PGKGLEWVSS IYPSGGRTVY      60
ADSVKGRFTI SRDNSKNTLY LQMNSLRAED TAVYYCAKDK FEWRLLFRGI GNDAFDIWGQ      120
GTMVTVSSAS TKGPSVFPLA PSSKS                                            145

M73-D06              LC
QSELTQPPSA SETPGQRVTI SCSGSSSNIG SNTVSWFQQL PGSAPRLLIY NDHRRPSGVP      60
DRFSGSKSGT SASLVISGLQ SQDEADYYCS AWDDSLNGVV FGGGTKLTVL                 110

M73-D06              HC
EVQLLESGGG LVQPGGSLRL SCAASGFTFS RYEMYWVRQA PGKGLEWVSS ISSSGGPTAY      60
ADSVKGRFTI SRDNSKNTLY LQMNSLRAED TAMYYCAKGT PKWELLLRSI YIENAFDIWG      120
QGTMVTVSSA STKGPSVFPL APSSKS                                           146

M76-D01              LC
QDIVMTQTPP SLPVNPGEPA SISCRSSQSL SDDGNTYLDW YLQRPGQSPQ LLIHTLSYRA      60
SGVPDRFSGS GSGTDFTLKI SRVEAEDVGV YYCMQGTHWP PTFGQGTKVE IK              112

M76-D01              HC
EVQLLESGGG LVQPGGSLRL SCAASGFTFS FYAMHWVRQA PGKGLEWVSG IVPSGGRTHY      60
ADSVKGRFTI SRDNSKNTLY LQMNSLRAED TAVYYCATDS SGSPNPLFDY WGQGTLVTVS      120
SASTKGPSVF PLAPSPKS                                                    138

M110-C12             LC
QDIQMTQSPL SLSVTPGEPA SISCRSSLSL LHSNGYNYLD WYVQRPGQSP QLLMYLSSTR      60
ASGVPDRFSG SGSGTDFTLE ISRVEAEDVG VYYCMQPLET PPTFGGGTKV EIK             113

M110-C12             HC
EVQLLESGGG LVQPGGSLRL SCAASGFTFS YYEMDWVRQA PGKGLEWVSG ISSSGGHTAY      60
ADSVKGRFTI SRDNSKNTLY LQMNSLRAED TATYYCARER RSSSRARYYY GMDVWGQGTT      120
VTVSSASTKG PSVFPLAPSS KS                                               142

M137-E12             LC
QSVLIQPPSV SGIPGQRVTI SCSGNNSNFG SNTVTWYQQL PGTAPKLLIY SDSRRPSGVP      60
DRFSGSRSDT SASLAISGLQ SEDEAEYHCA AWDDSLNGVF GGGTKLTVL                  109

M137-E12             HC
EVQLLESGGG LVQPGGSLRL SCAASGFTFS DYRMQWVRQA PGKGLEWVSV IVPSGGNTMY      60
ADSVKGRFTI SRDNSKNTLY LQMNSLRAED TAVYYCARGG PGSSIAARRA PTGYYGMDVW      120
GQGTTVTVSS ASTKGPSVFP LAPSSKS                                          147

M142-H08             LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                   108

M142-H08             HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRELKS NYFDYWGQGT      120
LVTVSSASTK GPSVFPLAPS SKS                                              143

M145-D01             LC
QDIQMTQSPA TLSLSPGERA TLSCRASQSV SSYLAWYQQK PGQAPRLLIY DASNRATGIP      60
ARFSGSGSGT DFTLTISSLE PEDFAVYYCQ QRSNWPRGFT FGPGTKVDIK                 110
```

```
M145-D01              HC
EVQLLESGGG LVQPGGSLRL SCAASGFTFS YYHMSWVRQA PGKGLEWVSV ISPSGGSTKY      60

ADSVKGRFTI SRDNSKNTLY LQMNSLRAED TAVYYCARGG SSDYAWGSYR RPYYFDYWGQ     120

GTLVTVSSAS TKGPSVFPLA PSSKS                                          145

M145-D11              LC
QSVLTQPPSV SVSPGQTASI TCSGDKLGDK YTSWYQQRPG QSPVLVIYQD IKRPSGIPER      60

FSGSNSGNTA TLTISGTQAM DEADYYCQAW DSPNARVFGS GTKVTVL                  107

M145-D11              HC
EVQLLESGGG LVQPGGSLRL SCAASGFTFS HYRMSWVRQA PGKGLEWVSS IYPSGGRTVY      60

ADSVKGRFTI SRDNSKNTLY LQMNSLRAED TAVYYCAKDK FEWRLLFRGI GNDAFDIWGQ     120

GTMVTVSSAS TKGPSVFPLA PSSKS                                          145

M146-E12              LC
QDIQMTQSPS SLSASVGDRV TITCRASGDI GNALGWYQQK PGKAPRLLIS DASTLQSGVP      60

LRFSGSGSGT EFTLTISSLQ PEDFATYYCL QGYNYPRTFG QGTKLEIR                 108

M146-E12              HC
EVQLLESGGG LVQPGGSLRL SCAASGFTFS RYIMHWVRQA PGKGLEWVSS ISPSGGLTSY      60

ADSVKGRFTI SRDNSKNTLY LQMNSLRAED TAVYYCAREF ENAYHYYYYG MDVWGQGTTV     120

TVSSASTKGP SVFPLAPSSK S                                              141

M152-A12              LC
QDIQMTQSPS SLSASVGDRV TITCRASQSI SSYLSWYQQR PGKAPNLLIY AASSLQSGVP      60

SRFSGSGSGT DFTLTISSLQ PEDFATYYCQ QSISIPRTFG QGTKVEVK                 108

M152-A12              HC
EVQLLESGGG LVQPGGSLRL SCAASGFTFS PYFMGWVRQA PGKGLEWVSG IGPSGGSTTY      60

ADSVKGRFTI SRDNSKNTLY LQMNSLRAED TAVYYCAREG PPYSSGWYRG LRQYHFDYWG     120

QGTLVTVSSA STKGPSVFPL APSSKS                                         146

M160-G12              LC
QDIQMTQSPS FLSASVGDRV TITCRASQGI SSYLAWYQQK PGKAPKLLIY AASTLQSGVP      60

SRFSGSGSGT EFTLTISSLQ PEDFATYYCQ QLNSYPLTFG GGTKVEIK                 108

M160-G12              HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YFDYWGQGTL     120

VTVSSASTKG PSVFPLAPSS KS                                             142

M161-C11              LC
QSALTQPPSV SVSPGQTASI TCSGDKLGDK YVSWYQQRPG QSPVLVIYQD TKRPSGIPER      60

FSGSNSGNTA TLTISGTQAV DEADYYCQAW DSSTYVFGGG TKVTVL                   106

M161-C11              HC
EVQLLESGGG LVQPGGSLRL SCAASGFTFS DYAMKWVRQA PGKGLEWVSS ISSSGGVTQY      60

ADSVKGRFTI SRDNSKNTLY LQMNSLRAED TAVYYCAREE DYSSSWYSRR FDYYYGMDVW     120

GQGTTVTVSS ASTKGPSVFP LAPSSKS                                        147

M162-A04              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                  107

M162-A04              HC
EVQLLESGGG LVQPGGSLRL SCAASGFTFS HYIMMWVRQA PGKGLEWSG IYSSGGITVY       60

ADSVKGRFTI SRDNSKNTLY LQMNSLRAED TAVYYCAYRR TGIPRRDAFD IWGQGTMVTV     120

SSASTKGPSV FPLAPSSKS                                                 139

X67-B03 LC
QDIQMTQSPS SLSAFVGDRV TITCRASQPI DNYLNWYHQK PGKAPKLLIY AASRLQSGVP      60
```

-continued

```
SRLSGSGFGT DFTLTISSLQ PEDFGNYYCQ QSYTVPYTFG GGTKVEIR                  108

X67-B03 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWSRELKS NYFDYWGQGT     120

LVTVSSASTK GPSVFPLAPS SKS                                             143

X67-C03 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-C03 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWMRELKS NYFDYWGQGT     120

LVTVSSASTK GPSVFPLAPS SKS                                             143

X67-C09 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-C09 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWGRELKS NYFDYWGQGT     120

LVTVSSASTK GPSVFPLAPS SKS                                             143

X67-D03 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-D03 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWNRELKS NYFDYWGQGT     120

LVTVSSASTK GPSVFPLAPS SKS                                             143

X67-E04 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-E04 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWDRELKS NYFDYWGQGT     120

LVTVSSASTK GPSVFPLAPS SKS                                             143

X67-F01 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-F01 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWQRELKS NYFDYWGQGT     120

LVTVSSASTK GPSVFPLAPS SKS                                             143

X67-F10 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                  108

X67-F10 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWTRELKS NYFDYWGQGT     120

LVTVSSASTK GPSVFPLAPS SKS                                             143
```

-continued

```
X67-G04 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-G04 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWARELKS NYFDYWGQGT     120

LVTVSSASTK GPSVFPLAPS SKS                                             143

X67-H04 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-H04 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWERELKS NYFDYWGQGT     120

LVTVSSASTK GPSVFPLAPS SKS                                             143
Note:
X81-B01 is a germilined IgG derived from X63-
G06 which is shown in Table 7.
```

TABLE 2

CDR Amino Acid Sequences and ELISA Signal of Antibody Binders of PKal (SEQ ID NOs: 294-743)

| Initial Name | Human pKal ELISA (T/B) | LV-CDR1 (SEQ ID NOs: 294-368) | LV-CDR2 (SEQ ID NOs: 369-443) | LV-CDR3 (SEQ ID NOs: 444-518) | HV-CDR1 (SEQ ID NOs: 519-593) | HV-CDR2 (SEQ ID NOs: 594-668) | HV-CDR3 (SEQ ID NOs: 669-743) |
|---|---|---|---|---|---|---|---|
| M6-A06 | 11.7 | RASQSISMYLN | GTSSLQS | QQSYSAPWT | LYQMT | GIWPSGGFTDYADSVKG | VSTAVADNDY |
| M6-A08 | 23.4 | RASQRISFYLN | GASSLQS | QQTFSTPNT | PYPMQ | SISSSGGMTEYADSVKG | DDYGGKGGAFDI |
| M6-D03 | 15.5 | RASQSISSYLN | AASSLQS | QQSYSTLWT | KYFMG | VIGSSGGWTSYADSVKG | VSTAVADNDY |
| M6-D08 | 16 | RASQSISSYLN | GASSLQS | QQSYTRWT | RYHMV | SISPSGGWTNYADSVKG | EMATIAGQFDP |
| M6-G05 | 18.5 | RASQSISTYLN | NAFSMER | QQSYTPTT | RYRMV | SIYPSGGMTAYADSVKG | DAVGIGDAFDI |
| M8-C04 | 44.7 | SGDKLGDKYTS | QDSKRPS | QAWDSSTV | YYPMQ | YIYPSGGLTSYADSVKG | LFYGSGSVGFEY |
| M8-D05 | 11.9 | RASQDISSWLV | DASNLQS | QQADGFPLT | LYNMN | SISPSGGFTDYADSVKG | DLDLGILDY |
| M8-E06 | 8.8 | RASQSISSYLN | AASSLQS | QQSYSTLMYT | HYFMT | SIVPSGGMTQYADSVKG | DSYSSSWFDI |
| M8-G09 | 28.2 | RASQGVSYYLA | GASSLQS | QQYNTYPPT | LYEML | VIYPSGGYTDYADSVKG | SFSGFGEIDY |
| M8-H04 | 3.3 | RASQYISTYLN | GTSSLQS | QQSFTTPFT | GYWMG | SISSSGGWTQYADSVKG | DDEIAAGGAFDI |
| M9-A03 | 14.4 | RASQNIDIYLN | GAYNLQS | QQSYGTPV | GYFMM | SIYSSGGYTDYADSVKG | EVAGTYAFDI |
| M9-A08 | 5.5 | RASQRISTYLN | GASSLQS | QQSYNTPRT | AYEMW | YIGSSGGSTSYADSVKG | GNSSSFDAFDI |
| M9-C08 | 10.9 | RASQSISIYVN | AASSLQR | QQSFSTPLT | HYGMV | YIVPSGGLTYYADSVKG | VDYTGDGLGY |
| M9-C10 | 7.8 | RASQGISSYLN | GASSLQS | QESYSTLFT | LYPMQ | SIGSSGGMTFYADSVKG | EVGAAGFAFDI |
| M9-D08 | 35.9 | RASRTISFYLN | GGSSLHS | QQSFSSPWT | WYKMM | SIYPSGGWTNYADSVKG | GSPWGDDAFDI |
| M9-E04 | 18.8 | RASQSISGYLN | AASNLQT | QQSHTPPKT | EYDMM | SIGSSGGMTYYADSVKG | DQVAAAAIDY |
| M9-F08 | 10.9 | RASQSISSYLN | AASSLQS | QQSYSTPPYT | PYAMT | VIYPSGGFTDYADSVKG | ASGSYLDAFDI |
| M9-F09 | 7 | RASQSISSYLN | AASSLQS | QQTYTTPWT | SYPMG | RISSSGGMTIYADSVKG | DDWNVGMDV |
| M9-F10 | 8.4 | RASQSINTYLN | AASTLES | QQSYSTPYT | DYDME | SISPSGGSTIYADSVKG | QGLLTAFDI |
| M9-G08 | 4.8 | RASQSISSYLN | AASSLQS | QQSYSTPIT | YYTML | SIYPSGGFTMYADSVKG | VDTAMAMIDY |
| M9-H02 | 3.5 | RASRSIATYLN | GASTLQS | QQSFSDPYT | AYMMI | VIYPSGGVTMYADSVKG | GTVGASDAFDI |
| M9-H03 | 4.4 | SGDKLGNRYTS | QDNKRPS | QALDSNTYV | WYSMG | YIVPSGGYTMYADSVKG | DPGVSYYYYGMDV |

TABLE 2-continued

CDR Amino Acid Sequences and ELISA Signal of Antibody Binders of PKal (SEQ ID NOs: 294-743)

| Initial Name | Human pKal ELISA (T/B) | LV-CDR1 (SEQ ID NOs: 294-368) | LV-CDR2 (SEQ ID NOs: 369-443) | LV-CDR3 (SEQ ID NOs: 444-518) | HV-CDR1 (SEQ ID NOs: 519-593) | HV-CDR2 (SEQ ID NOs: 594-668) | HV-CDR3 (SEQ ID NOs: 669-743) |
|---|---|---|---|---|---|---|---|
| M9-H04 | 16.1 | RASQSISSYLN | AASSLQS | QQSYSTPPT | AYTMW | SIWPSGGSTFYADSVKG | TYDSSAGEVDY |
| M10-A03 | 33.7 | RASQRISFYLN | GASSLQS | QQTFSTPNT | PYPMQ | SISSSGGMTEYADSVKG | DDYGGKGGAFDI |
| M10-A12 | 20.8 | RASRDISVYLN | GASSLQS | QQSYSIPFT | LYLMH | SIYSSGGFTTYADSVKG | DTDYGMDV |
| M10-B09 | 14.1 | RASQSISTYLN | GASSLQS | QQSFSTPWT | WYEMS | RIWPSGGVTMYADSVKG | TSITTVGMDV |
| M10-C11 | 5.3 | RASQSISIYLN | AASTLQS | QQSHSIPPT | MYPMM | YISPSGGMTDYADSVKG | VAGSSDAFDI |
| M10-D11 | 6.4 | RSSQSLLHSNGYNYLD | LGSNRAS | MQALQTPLT | AYPMN | RISSSGGNTSYADSVKG | GYLGY |
| M10-E06 | 32.8 | RASQSISTYLN | GASSLQS | QQSYSDPYT | LYRMF | SIWSSGGPTMYADSVKG | EYPSTYYFDY |
| M10-F09 | 4.8 | RASQTIDDDLI | AASSLQS | QQSYNIPRT | NYDMM | YISPSGGFTRYADSVKG | DIYYYNWGPSHYFDS |
| M10-G09 | 7.1 | RASQSISGYIN | AASSLQS | QQYVSYPFT | QYGMQ | SIRSSGGATRYADSVKG | DGYYDSSGYPDY |
| M11-A10 | 25 | RASQSIDTYLN | DASNL | QHYLYAPYS | NYWMM | GIGSSGGFTSYADSVKG | GSYSDYGVFES |
| M11-E01 | 11.7 | RASQSISSYLN | AASSLQS | QQSYSTPPT | TYEMY | GIGSSGGMTMYADSVKG | EQPGIAALQF |
| M11-E04 | 43.2 | RASQSISIYLT | GAATLQT | QQTFSLPRT | MYHMN | GIVSSGGVTFYADSVKG | ITTVTTGGAFDI |
| M11-E05 | 41.4 | RTSQTINNYLN | ATHTLES | QQSFAFPYT | WYTMG | WIYFGGLTTYADSVKG | LGGPLDAFDI |
| M11-E06 | 12.6 | RASRGIGTYLN | AASSLET | QESFTNVYN | QYAMH | SIYPSGGFTLYADSVKG | GGWLAGGELLN |
| M11-G09 | 23.6 | RTSQGINHYLN | AASELQT | QQTYTSPYT | LYNMT | YIYPSGGTHYADSVKG | DTGFWSADAFDI |
| M11-G12 | 4.9 | RASQTISVYVN | GASSLQS | QQSYSIPFT | QYPMN | SISSSGGFTTYADSVKG | EEQQGGFDY |
| M12-A08 | 40.4 | RASQSISRYLN | AASTLET | QQSYSTPYT | WYYMG | WIVSSGGLTLYADSVKG | TTVTTGDAFDI |
| M12-B04 | 18 | RASQGIRNDLG | AASILQS | LQDYEYPLT | LYSMY | RIRPSGGGTVYADSVKG | DPLYSSGDV |
| M12-C09 | 7 | RASQSIGIYLN | GASSLQS | QHSYSTPFT | SYAMV | SIGSSGGFTLYADSVKG | MNLGGGDAFDI |
| M12-C10 | 8.3 | SGDKLGEKYVS | QDNKRPS | QAWDSYTVV | DYEMH | GISPSGGKTQYADSVKG | DLKWGGRGSPDWYFDL |
| M12-D10 | 9.9 | RASQSISSYLN | AASSLQS | QQSYSTPPT | NYPMD | SISSSGGWTNYADSVKG | DTSGSYLGFDY |
| M12-E06 | 48 | RASQSISTYLN | GAFSLQS | QQSHSTPPT | QYKML | GIGPSGGLTAYADSVKG | APWFGELGMDV |
| M27-A10 | 3.2 | RASQSISAYLN | YGVGSLQS | QQGYTTPVT | WYRMD | SIWPSGGLTSYADSVKG | GWAPGGDAFDI |
| M27-B01 | 33.1 | RASQSISSYLN | AASSLQS | QQSYSTPYT | DYTMW | SISSSGGITFYADSVKG | SADTAMGGAFDI |
| M27-B12 | 2.3 | SGDKLGDEYAA | QDRKRPS | QAWGKRNVV | WYQMM | SISPSGGITEYADSVKG | DRSSGWYYYGMDV |
| M27-E03 | 35.9 | RASQSISSYLN | AASSLQS | QQSYSTPRT | SYMMH | GIYPSGGWTDYADSVKG | LVAGLDAFDI |
| M27-F04 | 10.5 | RASQSISSYLN | AASSLQS | QQSYSTPPT | WYPMT | SIGPSGGQTIYADSVKG | EYGDYGGGFDP |
| M27-F11 | 10 | RASQGISSYLA | AASSLQS | QQSYNTLRT | SYHMM | SIYPSGGATMYADSVKG | DGYHYGDYTYFQH |
| M27-G01 | 31.4 | RASQSISTYLN | GASSLQS | QQSYSDPYT | LYRMF | SIWSSGGPTMYADSVKG | EYPSTYYFDY |
| M27-G04 | 4.1 | RASQRISYYLT | AASSLES | QQAFSTPFT | AYYMV | YISPSGGQTQYADSVKG | EAISSSSFDY |
| M27-G09 | 2.2 | RTRQSISNYLN | AASSLQS | QQSYDIPFT | EYDMA | YIVSSGGFTSYADSVKG | WAGWIAAADY |
| M27-H10 | 12.4 | RASQSISNYLN | AASSLQS | QQSYSTPQT | AYQMA | VIYSSGGYTDYADSVKG | HNWNDGAFDI |
| M28-A01 | 19 | RASQSISSYLN | AASSLQS | QQSYSTLT | WYAMH | GIYSSGGYTKYADSVKG | DLSNGDDVFDI |
| M28-C03 | 2.2 | RASQSINFYLN | VASSLES | LQSYSAPYT | YYQMG | SIYPSGGMTDYADSVKG | GSPWGDDAFDI |
| M28-D02 | 3.7 | RTSRRIGTYLN | GASSLQS | QQSFSSPWT | WYPMQ | YIYPSGGGTDYADSVKG | SSGWLGDAFDI |
| M28-D12 | 41.6 | RASQSIATYLN | AASSLQS | QQSYSTRET | WYTMH | VIYPSGGPTSYADSVKG | DGSGSYLGFDY |

TABLE 2-continued

CDR Amino Acid Sequences and ELISA Signal of Antibody Binders of PKal (SEQ ID NOs: 294-743)

| Initial Name | Human pKal ELISA (T/B) | LV-CDR1 (SEQ ID NOs: 294-368) | LV-CDR2 (SEQ ID NOs: 369-443) | LV-CDR3 (SEQ ID NOs: 444-518) | HV-CDR1 (SEQ ID NOs: 519-593) | HV-CDR2 (SEQ ID NOs: 594-668) | HV-CDR3 (SEQ ID NOs: 669-743) |
|---|---|---|---|---|---|---|---|
| M28-E01 | 41 | RASQSISSYLN | AASSLQS | QQTYTTPWT | SYPMG | RISSSGGMTIYADSVKG | DDWNVGMDV |
| M28-E11 | 29.3 | RASQDISNWLA | AASSLQT | QQSYSLPWT | LYDMT | GISSSGGVTIYADSVKG | TYYYDSSGYADAFDI |
| M28-F01 | 1.5 | RASQSINTYLN | AASTLES | QQSYSTPPT | VYLMH | GISPSGGYTQYADSVKG | PGGLDAFDI |
| M28-F05 | 31.4 | RASQSISSYLN | AASSLQS | QQSYSTPLT | RYIMW | GIYSSGGYTQYADSVKG | ELEGLGGFDY |
| M28-F07 | 33 | RASQGISSWLA | ATSGLQS | QQAKSFPLT | DYTMY | SIVPSGGHTLYADSVKG | DHLSSWYGGFFDY |
| M29-C07 | 5.2 | RASQSISSYLN | AASSLQS | QQSYSTRYT | GYDMM | VISSSGGNTAYADSVKG | ESSGLYYFDY |
| M29-D10 | 23.6 | RASQSITIYLN | GASNLHS | QQSYDTPLT | WYPMY | SIGSSGGPTPYADSVKG | WADYGGSLDY |
| M29-E02 | 2 | SGSSSNIGNNAVS | YDDLLPS | AAWDDSLNGFV | RYPMM | VIYPSGGDTFYADSVKG | GDDYLWEAAVY |
| M29-G08 | 40.4 | RASQNIGNDVA | HASTRAY | QQFYDWPAHT | YYHMW | GISPSGGFTFYADSVKG | DYYYDSSGYSPLGY |
| M29-G10 | 16.4 | RASQSISIYLN | GASQLES | QQSYNVPYT | FYKMI | SISSSGGSTQYADSVKG | DRVDLGYLDY |
| M74-A07 | 8.6 | RTSQNINTYLN | GVSSLHR | QQSYSSPWT | QYLMM | SIYPSGGYTSYADSVKG | VSTAVADNDY |
| M76-F02 | 6.4 | RASQTIDNYLH | DASSLQS | QQSYDTPQYT | LYDMN | GISPSGGQTMYADSVKG | QPMISAFDI |
| M76-G02 | 10.3 | RASQSISSYLN | AASSLQS | QQSYSTPPWT | LYAMW | YISSSGGFTSYADSVKG | YRVGVAATDY |
| M76-G06 | 11.8 | RASQSISTYLN | AASSLQS | QQSYSTPHT | GYIMH | WIYPSGGWTEYADSVKG | DAPGVGAIDY |
| M76-H02 | 13.4 | RASQDISVYLN | GGASLQS | QQSYSLPFT | MYWMQ | YIYPSGGPTKYADSVKG | PSGSYGDAFDI |
| M77-C07 | 16.1 | RASQNISSYLN | AASSLQS | QQSYSTPRT | LYIMG | GIYPSGGFTMYADSVKG | ESSGVAAPDY |
| M77-H04 | 7.6 | RSSQSLLHSRGYNYLD | LGSNRAS | MQALQRRT | YYTMI | GIRSSGGGTRYADSVKG | DGSRYSYGSIYYYYGMDA |

Abbreviations used:
"T/B" is the ELISA signal obtained using of the "target" (biotinylated plasma kallikrein) divided by the ELISA signal of the "background" (streptavidin); both of which were coated on microtiter plates.
"nd" is not determined.
The symbol "q" refers to the amber suppressible stop codon (TAG), which is translated as glutamine (Q) in strains of E. coli such as the TG1 cells that were used to express the Fab fragments.

Amino Acid Sequences of Light Chain (LC) and Heavy Chain (HC) Variable Domain of pKal Antibody Binders are Shown Below. (SEQ ID NOs:744-893 Numbered in Order from Top to Bottom)

```
M6-A06                  LC
QDIQMTQSPS SLSASVGDSV TISCRASQSI SMYLNWYQHK PGKAPKLLIY GTSSLQSGVP 60

SRFSGSGPGG TDFTLTISSL QPEDFATYYC QQSYSAPWTF GQGTKVEIK              109

M6-A06                  HC
EVQLLESGGG LVQPGGSLRL SCAASGFTFS LYQMTWVRQA PGKGLEWVSG IWPSGGFTDY 60

ADSVKGRFTI SRDNSKNTLY LQMNSLRAED TAVYYCARVS TAVADNDYWG QGTLVTVSSA 120

STKGPSVFPL APSSKS                                                 136

M6-A08                  LC
QDIQMTQSPS SLSASVGDRV TITCRASQRI SFYLNWFQQK PGKAPNLLIY GASSLQSGVP 60

SRFSGSGSGT DFTLTISSLQ PKDFGTYYCQ QTFSTPNTFG QGTKLEIK               108

M6-A08                  HC
EVQLLESGGG LVQPGGSLRL SCAASGFTFS PYPMQWVRQA PGKGLEWVSS ISSSGGMTEY 60

ADSVKGRFTI SRDNSKNTLY LQMNSLRAED TAVYYCARDD YGGKGGAFDI WGQGTMVTVS 120

SASTKGPSVF PLAPSSKS                                               138
```

```
M6-D03                   LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTLWTFG QGTKVEIK            108

M6-D03                   HC
EVQLLESGGG LVQPGGSLRL SCAASGFTFS KYFMGWVRQA PGKGLEWVSV IGSSGGWTSY60

ADSVKGRFTI SRDNSKNTLY LQMNSLRAED TAVYYCARVS TAVADNDYWG QGTLVTVSSA120

STKGPSVFPL APSSKS                                              136

M6-D08                   LC
QDIQMTQSPS SLSASVGDRV TITCRASQSI SSYLNWYqQK PGKAPKLLIY GASSLQSGVP60

SRFSGSGSGT DFTLTISSLQ PEDSATYYCQ QSYTRWTFGQ GTKVEIK             107

M6-D08                   HC
EVQLLESGGG LVQPGGSLRL SCAASGFTFS RYHMVWVRQA PGKGLEWVSS ISPSGGWTNY60

ADSVKGRFTI SRDNSKNTLY LQMNSLRAED TAMYYCAREM ATIAGQFDPW GQGTLVTVSS120

ASTKGPSVFP LAPSSKS                                             137

M6-G05                   LC
QDIQMTQSPS SLSASVGDRV TITCRASQSI STYLNWYQLK PGKAPKLLIY NAFSMERGVP60

STISGSGSGT DFTLTISSLQ PEDFATYYCQ QSYTTPTTFG QGTKVEIK            108

M6-G05                   HC
EVQLLESGGG LVQPGGSLRL SCAASGFTFS RYRMVWVRQA PGKGLEWVSS IYPSGGMTAY60

ADSVKGRFTI SRDNSKNTLY LQMNSLRAED TAVYYCARDA VGIGDAFDIW GQGTMVTVSS120

ASTKGPSVFP LAPSSKS                                             137

M8-C04                   LC
QSALTQPPSV SVSPGQTASI TCSGDKLGDK YTSWHQQKPG QSPVLVIYQD SKRPSGIPER60

FSGSNSGNTA TLTISGTQAM DEADYYCQAW DSSTVFGGGT RLTVL               105

M8-C04                   HC
EVQLLESGGG LVQPGGSLRL SCAASGFTFS YYPMQWVRQA PGKGLEWVSY IYPSGGLTSY60

ADSVKGRFTI SRDNSKNTLY LQMNSLRAED TAVYYCARLF YGSGSVGFEY WGQGTLVTVS120

SASTKGPSVF PLAPSSKS                                            138

M8-D05                   LC
QDIQMTQSPS FVSASVGDRV TITCRASQDI SSWLVWYQQK PGKGPKLLIY DASNLQSGVP60

SRFSGGGSGT HFTLTISSLQ PEDFATYYCQ QADGFPLTFG GGTKVEMK            108

M8-D05                   HC
EVQLLESGGG LVQPGGSLRL SCAASGFTFS LYNMNWVRQA PGKGLEWVSS ISPSGGFTDY60

ADSVKGRFTI SRDNSKNTLY LQMNSLRAED TAVYYCARDL DLGILDYWGQ GTLVTVSSAS120

TKGPSVFPLA PSSKS                                               135

M8-E06                   LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTLMYTF GQGTKLEIK           109

M8-E06                   HC
EVQLLESGGG LVQPGGSLRL SCAASGFTFS HYFMTWVRQA PGKGLEWVSS IVPSGGMTQY60

ADSVKGRFTI SRDNSKNTLY LQMNSLRAED TAVYYCARDS YSSSWFDIWG QGTMVTVSSA120

STKGPSVFPL APSSKS                                              136

M8-G09                   LC
QDIQMTQSPS SLSASVGDTV TITCRASQGV SYYLAWFQQK PGKAPKSLIY GASSLQSGVP60

SKFSGSGSGT VFTLTISSLQ PDDFATYYCQ QYNTYPPTFG QGTRLDIK            108

M8-G09                   HC
EVQLLESGGG LVQPGGSLRL SCAASGFTFS LYEMLWVRQA PGKGLEWVSV IYPSGGYTDY60
```

```
                 -continued
ADSVKGRFTI SRDNSKNTLY LQMNSLRAED MAVYYCARSF SGFGEIDYWG QGTLVTVSSA120

STKGPSVFPL APSSKS                                              136

M8-H04                  LC
QDIQMTQSPS SLSASIGDRV TITCRASQYI STYLNWYEQK PGKAPKLLIY GTSSLQSGVP60

SRFSGSGSGT EFSLTISSLQ PEDFATYYCQ QSFTTPFTFG QGTKLEIK             108

M8-H04                  HC
EVQLLESGGG LVQPGGSLRL SCAASGFTFS GYWMGWVRQA PGKGLEWVSS ISSSGGWTQY60

ADSVKGRFTI SRDNSKNTLY LQMNSLRAED TATYYCARDD EIAAGGAFDI WGQGAMVTVS120

SASTKGPSVF PLAPSSKS                                            138

M9-A03                  LC
QDIQMTQSPS SLSASLGDRV TITCRASQNI DIYLNWYQQT PGKAPKLLIY GAYNLQSGVP60

SRFSGSGSGT DFTLTISSLQ PEDFGTYYCQ QSYGTPVFGQ GTKLEIK              107

M9-A03                  HC
EVQLLESGGG LVQPGGSLRL SCAASGFTFS GYFMMWVRQA PGKGLEWVSS IYSSGGYTDY60

ADSVKGRFTI SRDNSKNTLY LQMNSLRAED TAVYYCAREV AGTYAFDIWG QGTMVTVSSA120

STKGPSVFPL APSSKS                                              136

M9-A08                  LC
QDIQMTQSPS SLSASVGDRV TVTCRASQRI STYLNWYQQK PGKAPKLLIS GASSLQSGVP60

SRFSGSGSGT DFTLTISSLQ PDDFATYYCQ QSYNTPRTFG QGTKVEIR             108

M9-A08                  HC
EVQLLESGGG LVQPGGSLRL SCAASGFTFS AYEMWWVRQA PGKGLEWVSY IGSSGGSTSY60

ADSVKGRFTI SRDNSKNTLY LQMNSLRAED TAVYYCTGGN SSSFDAFDIW GQGTMVTVSS120

ASTKGPSVFP LAPSSKS                                             137

M9-C08                  LC
QDIQMTQSPS SLSASVGDRV TITCRASQSI SIYVNWYQQK PGKAPNLLIF AASSLQRGVP60

SRFSGSGSGA DFTLTISSLQ PEDFATYYCQ QSFSTPLTFG GGTKVEIK             108

M9-C08                  HC
EVQLLESGGG LVQPGGSLRL SCAASGFTFS HYGMVWVRQA PGKGLEWVSY IVPSGGLTYY60

ADSVKGRFTI SRDNSKNTLY LQMNSLRAED TAVYYCARVD YTGDGLGYWG QGTLVTVSSA120

STKGPSVFPL APSSKS                                              136

M9-C10                  LC
QDIQMTQSPS SLSASVGDRV TITCRASQGI SSYLNWYQQK PGNAPNLLIY GASSLQSGVP60

SRFSGSGSGT DFTLTISSLQ PEDFATYYCQ ESYSTLFTFG PGTTVEIK             108

M9-C10                  HC
EVQLLESGGG LVQPGGSLRL SCAASGFTFS LYPMQWVRQA PGKGLEWVSS IGSSGGMTFY60

ADSVKGRFTI SRDNSKNTLY LQMNSLRAED TAVYYCTREV GAAGFAFDIW GQGTMVTVSS120

ASTKGPSVFP LAPSSKS                                             137

M9-D08                  LC
QDIQMTQSPS SLSASVGDRV TLTCRASRTI SFYLNWYQQK AGKAPELLIY GGSSLHSGVP60

SRFSGSGSGT DFSLTISNLQ PEDIAVYYCQ QSFSSPWTFG QGTKVEIK             108

M9-D08                  HC
EVQLLESGGG LVQPGGSLRL SCAASGFTFS WYKMMWVRQA PGKGLEWVSS IYPSGGWTNY60

ADSVKGRFTI SRDNSKNTLY LQMNSLRAED TAVYYCTRGS PWGDDAFDIW GQGTMVTVSS120

ASTKGPSVFP LAPSSKS                                             137

M9-E04                  LC
QDIQMIQSPS SLSASVGDRV TITCRASQSI SGYLNWYQQR SGKAPKLLIF AASNLQTGVP60

SRFSGSGSGT DFTLTINNLQ PEDFATYYCQ QSHTPPKTFG PGTKVDIK             108
```

```
-continued
M9-E04               HC
EVQLLESGGG LVQPGGSLRL SCAASGFTFS EYDMMWVRQA PGKGLEWVSS IGSSGGMTYY60

ADSVKGRFTI SRDNSKNTLY LQMNSLRAED TAVYYCARDQ VAAAAIDYWG QGTLVTVSSA120

STKGPSVFPL APSSKS                                               136

M9-F08               LC
QDIQMTqSPS SLSASVGDRV TITCRASQSI SSYLNWYQQK PGKAPKLLIY AASSLQSGVP60

SRFSGSGSGT DFTLTISSLQ PEDFATYYCQ QSYSTPPYTF GQGTKLEIK           109

M9-F08               HC
EVQLLESGGG LVQPGGSLRL SCAASGFTFS PYAMTWVRQA PGKGLEWVSV IYPSGGFTDY60

ADSVKGRFTI SRDNSKNTLY LQMNSLRAED TAMYYCARAS GSYLDAFDIW GQGTMVTVSS120

ASTKGPSVFP LAPSSKS                                              137

M9-F09               LC
QDIQMTQSPS SLSASVGDRV TITCRASQSI SSYLNWYQQK PGKAPKLLIY AASSLQSGVP60

SKFSGSGSGT DYTLTISSLQ PEDFATYYCQ QTYTTPWTFG QGTKVEIK            108

M9-F09               HC
EVQLLESGGG LVQPGGSLRL SCAASGFTFS SYPMGWVRQA PGKGLEWVSR ISSSGGMTIY60

ADSVKGRFTI SRDNSKNTLY LQMNSLRAED TAVYYCARDD WNVGMDVWGQ GTTVTVSSAS120

TKGPSVFPLA PSSKS                                                135

M9-F10               LC
QDIQMTQSPS SLSASVGDRV TITCRASQSI NTYLNWYQQK PGKAPKVLIH AASTLESGVP60

SRFSGSGSGT DFTLTISSLQ PEDFATYYCQ QSYSTPYTFG QGTKLEVR            108

M9-F10               HC
EVQLLESGGG LVQPGGSLRL SCAASGFTFS DYDMEWVRQA PGKGLEWVSS ISPSGGSTIY60

ADSVKGRFTI SRDNSKNTLY LQMNSLRAED TAVYYCARQG LLTAFDIWGQ GTMVTVSSAS120

TKGPSVFPLA PSSKS                                                135

M9-G08               LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPITFG GGTKVEIK            108

M9-G08               HC
EVQLLESGGG LVQPGGSLRL SCAASGFTFS YYTMLWVRQA PGKGLEWVSS IYPSGGFTMY60

ADSVKGRFTI SRDNSKNTLY LQMNSLRAED TAVYYCARVD TAMAMIDYWG QGTLVTVSSA120

STKGPSVFPL APSSKS                                               136

M9-H02               LC
QDIQMTQSPS SLSASVGDRV IITCRASRSI ATYLNWYQQK PGKAPNLLIF GASTLQSGVP60

SRFSGSGSGT DFTLTISDLQ PEDFATYYCQ QSFSDPYTFG QGTNLEMK            108

M9-H02               HC
EVQLLESGGG LVQPGGSLRL SCAASGFTFS AYMMIWVRQA PGKGLEWVSV IYPSGGVTMY60

ADSVKGRFTI SRDNSKNTLY LQMNSLRAED TAVYYCARGT VGASDAFDIW GQGTMVTVSS120

ASTKGPSVFP LAPSSKS                                              137

M9-H03               LC
QYELTQAPSV SVAPGQTASI TCSGDKLGNR YTSWYQQKPG QSPVLVIFQD NKRPSGIPER60

FSGSNSGNTA TLTISGTQAM DEADYYCQAL DSNTYVFGTG TKVTVL              106

M9-H03               HC
EVQLLESGGG LVQPGGSLRL SCAASGFTFS WYSMGWVRQA PGKGLEWVSY IVPSGGYTMY60

ADSVKGRFTI SRDNSKNTLY LQMNSLRAED TAVYYCARDP GVSYYYYGMD VWGQGTTVTV120

SSASTKGPSV FPLAPSSKS                                            139

M9-H04               LC
QDIQMTQSPS SLSASVGDRV TITCRASQSI SSYLNWYQQK PGKAPKLLIY AASSLQSGVP60
```

```
SRFSGSGSGT DFTLTISSLQ PEDFATYYCQ QSYSTPPTFG QGTRLEIK            108

M9-H04               HC
EVQLLESGGG LVQPGGSLRL SCAASGFTFS AYTMWWVRQA PGKGLEWVSS IWPSGGSTFY60

ADSVKGRFTI SRDNSKNTLY LQMNSLRAED TAVYYCARTY DSSAGEVDYW GQGTLVTVSS120

ASTKGPSVFP LAPSSKS                                              137

M10-A03              LC
QDIQMTQSPS SLSASVGDRV TITCRASQRI SFYLNWFQQK PGKAPNLLIY GASSLQSGVP60

SRFSGSGSGT DFTLTISSLQ PKDFGTYYCQ QTFSTPNTFG QGTKLEIK            108

M10-A03              HC
EVQLLESGGG LVQPGGSLRL SCAASGFTFS PYPMQWVRQA PGKGLEWVSS ISSSGGMTEY60

ADSVKGRFTI SRDNSKNTLY LQMNSLRAED TAVYYCARDD YGGKGGAFDI WGQGTMVTVS120

SASTKGPSVF PLAPSSKS                                             138

M10-A12              LC
QDIQMTQSPL SLSAFVGDRV TITCRASRDI SVYLNWYQLK SGKAPKLLIY GASSLQSGVP60

SRFSGSGSGT DFTLTITSLQ PEDFATYYCQ QSYSIPFTFG GGTKVETK            108

M10-A12              HC
EVQLLESGGG LVQPGGSLRL SCAASGFTFS LYLMHWVRQA PGKGLEWVSS IYSSGGFTTY60

ADSVKGRFTI SRDNSKNTLY LQMNSLRAED TAVYYCARDT DYGMDVWGQG TTVTVSSAST120

KGPSVFPLAP SSKS                                                 134

M10-B09              LC
QDIQMTQSPS SLSASVGDGV TITCRASQSI STYLNWYQQR PGKAPKLLIY GASSLQSGVP60

SRFSGSGSGT DFTLTISSLQ REDFATYYCQ QSFSTPWTFG QGTRVEIK            108

M10-B09              HC
EVQLLESGGG LVQPGGSLRL SCAASGFTFS WYEMSWVRQA PGKGLEWVSR IWPSGGVTMY60

ADSVKGRFTI SRDNSKNTLY LqMNSLRAED TAVYYCTRTS ITTVGMDVWG QGTTVTVSSA120

STKGPSVFPL APSSKS                                               136

M10-C11              LC
QDIQMTQSPS SLSASVGDRV TITCRASQSI SIYLNWYQQK PEKAPKLLIF AASTLQSGVP60

SRFSGSGSGT DFTLTISNLQ PEDFATYYCQ QSHSIPPTFG LGTKVEVK            108

M10-C11              HC
EVQLLESGGG LVQPGGSLRL SCAASGFTFS MYPMMWVRQA PGKGLEWVSY ISPSGGMTDY60

ADSVKGRFTI SRDNSKNTLY LQMNSLRAED MAVYYCARVA GSSDAFDIWG QGTMVTVSSA120

STKGPSVFPL APSSKS                                               136

M10-D11              LC
QDIQMTQSPL SLPVTPGEPA SISCRSSQSL LHSNGYNYLD WYLQKPGQSP QLLIYLGSNR60

ASGVPDRFSG SGSGTDFTLK ISRVEAEDVG VYYCMQALQT PLTFGPGTKV HIK      113

M10-D11              HC
EVQLLESGGG LVQPGGSLRL SCAASGFTFS AYPMNWVRQA PGKGLEWVSR ISSSGGNTSY60

ADSVKGRFTI SRDNSKNTLY LQMNSLRAED TAVYYCALGY LGYWGQGTLV TVSSASTKGP120

SVFPLAPSSK S                                                    131

M10-E06              LC
QDIQMTQSPS SLSASVGDRV TITCRASQSI STYLNWYQQK PGKAPKLLIY GASSLQSGVP60

SRFSGSGSGT DFTLTISSLQ PEDFTIYYCQ QSYSDPYTFG QGTKLDIK            108

M10-E06              HC
EVQLLESGGG LVQPGGSLRL SCAASGFTFS LYRMFWVRQA PGKGLEWVSS IWSSGGPTMY60

ADSVKGRFTI SRDNSKNTLY LQMNSLRAED TAVYYCAREY PSTYYFDYWG QGTLVTVSSA120

STKGPSVFPL APSSKS                                               136
```

```
M10-F09           LC
QDIQMTQSPS SLSASVGDRV TITCRASQTI DDDLIWYQQK PGRAPKLLIY AASSLQSGVP60

SRFSGSGSGT DFTLTITSLQ PEDFATYYCQ QSYNIPRTFG QGTKLESK            108

M10-F09           HC
EVQLLESGGG LVQPGGSLRL SCAASGFTFS NYDMMWVRQA PGKGLEWVSY ISPSGGFTRY60

ADSVKGRFTI SRDNSKNTLY LQMNSLRAED TATYYCAKDI YYYNWGPSHY FDSWGQGTLV120

TVSSASTKGP SVFPLAPSSK S                                        141

M10-G09           LC
QDIQMTQSPS SLSASVGDSV TITCRASQSI SGYINWYQQK AGKAPKLLIY AASSLQSGVP60

SRFSGSGSGT HFTLTISSLQ PEDFATYYCQ QYVSYPFTFG PGTKVDIK            108

M10-G09           HC
EVQLLESGGG LVQPGGSLRL SCAASGFTFS QYGMQWVRQA PGKGLEWVSS IRSSGGATRY60

ADSVKGRFTI SRDNSKNTLY LQMNSLRAED TAVYYCARDG YYDSSGYPDY WGQGTLVTVS120

SASTKGPSVF PLAPSSKS                                            138

M11-A10           LC
QDIQMTQSPS SLSASVGDRV AITCRASQSI DTYLNWYQQK PGKAPKLLIY DASNLEIGVP60

SRFSGSGSGT DFTFIINSLQ PEDVATYYCQ HYLYAPYSFG QGTKLEIK            108

M11-A10           HC
EVQLLESGGG LVQPGGSLRL SCAASGFTFS NYWMMWVRQA PGKGLEWVSG IGSSGGFTSY60

ADSVKGRFTI SRDNSKNTLY LQMNSLRAED TAVYYCAKGS YSDYGVFESW GQGTLVTVSS120

ASTKGPSVFP LAPSSKS                                             137

M11-E01           LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPPTFG QGTKVEIK            108

M11-E01           HC
EVQLLESGGG LVQPGGSLRL SCAASGFTFS TYEMYWVRQA PGKGLEWVSG IGSSGGMTMY60

ADSVKGRFTI SRDNSKNTLY LQMNSLRAED TAMYYCAREQ PGIAALQFWG QGTLVTVSSA120

STKGPSVFPL APSSKS                                              136

M11-E04           LC
QDIQMTQSPS SLSASVGDRV TITCRASQSI SIYLTWYQHR PGKAPNLLIY GAATLQTGVP60

SRFSGSGSGT DFTLTIRGLQ PEDFATYYCQ QTFSLPRTFG QGTKLEIK            108

M11-E04           HC
EVQLLESGGG LVQPGGSLRL SCAASGFTFS MYHMNWVRQA PGKGLEWVSG IVSSGGVTFY60

ADSVKGRFTI SRDNSKNTLY LQMNSLRAED TAVYYCARIT TVTTGGAFDI WGQGTMVTVS120

SASTKGPSVF PLAPSSKS                                            138

M11-E05           LC
QDIQMTQSPS SLSASVGDTV TITCRTSQTI NNYLNWYQQR PGEAPKVLIY ATHTLESGVP60

SRFSGSGSGT DFTLTIGSLQ PEDFATYYCQ QSFAFPYTFG QGTKVEIT            108

M11-E05           HC
EVQLLESGGG LVQPGGSLRL SCAASGFTFS WYTMGWVRQA PGKGLEWVSW IYFGGLTTYA60

DSVKGRFTIS RDNSKNTLYL QMNSLRAEDT AVYYCARLGG PLDAFDIWGQ GTMVTVSSAS120

TKGPSVFPLA PSSKS                                               135

M11-E06           LC
QDIQMTQSPS SLSASIGDRV TISCRASRGI GTYLNWYQQH AGKAPKLLIR AASSLETGVP60

PRFSGSGSGT DFTLTISSLQ SDDFATYYCQ ESFTNVYNFG QGTKLEIK            108

M11-E06           HC
EVQLLESGGG LVQPGGSLRL SCAASGFTFS QYAMHWVRQA PGKGLEWVSS IYPSGGFTLY60
```

```
                             -continued
ADSVKGRFTI SRDNSKNTLY LQMNSLRAED TAMYYCARGG WLAGGELLNW GQGTLVTVSS120

ASTKGPSVFP LAPSSKS                                            137

M11-G09              LC
QDIQMTQSPS SLSASVGDRV TITCRTSQGI NHYLNWYQQK PGKAPKILVF AASELQTGVP60

SRFSGTGSGT SYTLTITSLQ PEDVATYYCQ QTYTSPYTFG QGTKLEVK          108

M11-G09              HC
EVQLLESGGG LVQPGGSLRL SCAASGFTFS LYNMTWVRQA PGKGLEWVSY IYPSGGGTHY60

ADSVKGRFTI SRDNSKNTLY LQMNSLRAED TAVYYCARDT GFWSADAFDI WGQGTMVTVS120

SASTKGPSVF PLAPSSKS                                          138

M11-G12              LC
QDIQMTQSPS SLSAFVGDRV SITCRASQTI SVYVNWYQHK SGQAPKLLIY GASSLQSGVP60

SRFSGSGSGT DFTLTISSLQ PEDFATYFCQ QSYSIPFTFG GGTDVQIR          108

M11-G12              HC
EVQLLESGGG LVQPGGSLRL SCAASGFTFS QYPMNWVRQA PGKGLEWVSS ISSSGGFTTY60

ADSVKGRFTI SRDNSKNTLY LQMNSLRAED TAVYYCAREE QQGGFDYWGQ GTLVTVSSAS120

TKGPSVFPLA PSSKS                                             135

M12-A08              LC
QDIQMTQSPS SLSASVGDRV TITCRASQSI SRYLNWYQQK PGKAPKLLIY AASTLETGVP60

SRFSGSGSGT DFTLTITTLQ PEDFVIYYCQ QSYSTPYTFG QGTKLEIK          108

M12-A08              HC
EVQLLESGGG LVQPGGSLRL SCAASGFTFS WYYMGWVRQA PGKGLEWVSW IVSSGGLTLY60

ADSVKGRFTI SRDNSKNTLY LQMNSLRAED TAMYYCARTT VTTGDAFDIW GQGTMVTVSS120

ASTKGPSVFP LAPSSKS                                           137

M12-B04              LC
QDIQMTQSPS SLSASVGDRV TITCRASQGI RNDLGWYQHK PGKAPKLLIY AASILQSGVP60

SRFSGTASGT DFTLTISSLQ PEDFATYFCL QDYEYPLTFG GGTKLDIK          108

M12-B04              HC
EVQLLESGGG LVQPGGSLRL SCAASGFTFS LYSMYWVRQA PGKGLEWVSR IRPSGGGTVY60

ADSVKGRFTI SRDNSKNTLY LQMNSLRAED TAVYYCARDP LYSSGDVWGQ GTTVTVSSAS120

TKGPSVFPLA PSSKS                                             135

M12-C09              LC
QDIQMTQSPS SLSASVGDRV TITCRASQSI GIYLNWYHQK PGKAPNLLIY GASSLQSGVP60

SRFSGSGSGT DFTLTISSLQ PGDFATYYCQ HSYSTPFTFG GGTKVEIK          108

M12-C09              HC
EVQLLESGGG LVQPGGSLRL SCAASGFTFS SYAMVWVRQA PGKGLEWVSS IGSSGGFTLY60

ADSVKGRFTI SRDNSKNTLY LQMNSLRAED TAVYYCASMN LGGGDAFDIW GQGTMVTVSS120

ASTKGPSVFP LAPSSKS                                           137

M12-C10              LC
QSALTQPPSV SVSPGQTASI TCSGDKLGEK YVSWYQQKPG QSPVVIYQD NKRPSGIPER60

FSGSNSGNTA TLTISGTQAV DEADYYCQAW DSYTVVFGGG SKLTVLGQPK       110

M12-C10              HC
EVQLLESGGG LVQPGGSLRL SCAASGFTFS DYEMHWVRQA PGKGLEWVSG ISPSGGKTQY60

ADSVKGRFTI SRDNSKNTLY LQMNSLRAED TAVYYCARDL KWGGRGSPDW YFDLWGRGTL120

VTVSSASTKG PSVFPLAPSS KS                                     142

M12-D10              LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPPTFG GGTKVEIK          108
```

```
M12-D10             HC
EVQLLESGGG LVQPGGSLRL SCAASGFTFS NYPMDWVRQA PGKGLEWVSS ISSSGGWTNY60

ADSVKGRFTI SRDNSKNTLY LQMNSLRAED TAVYYCATDT SGSYLGFDYW GQGTLVTVSS120

ASTKGPSVFP LAPSSKS                                              137

M12-E06             LC
QDIQMTQSPS SLSASVGDRV SITCRASQSI STYLNWYQHK PGKAPTLLIY GAFSLQSGVP60

SRFSGSGSGT DFALTISSLQ PEDFATYYCQ QSHSTPPTFG QGTRVEIK            108

M12-E06             HC
EVQLLESGGG LVQPGGSLRL SCAASGFTFS QYKMLWVRQA PGKGLEWVSG IGPSGGLTAY60

ADSVKGRFTI SRDNSKNTLY LQMNSLRAED TAVYYCARAP WFGELGMDVW GQGTTVTVSS120

ASTKGPSVFP LAPSSKS                                              137

M27-A10             LC
QDIQMTQSPS SLSASVGDRV TITCRASQSI SAYLNWYQQK PGKAPQLLMY GVGSLQSGVP60

SRFSGSGSGT DFTLTISSLQ PEDFATYFCQ QGYTTPVTFG GGTKVEIK            108

M27-A10             HC
EVQLLESGGG LVQPGGSLRL SCAASGFTFS WYRMDWVRQA PGKGLEWVSS IWPSGGLTSY60

ADSVKGRFTI SRDNSKNTLY LQMNSLRAED TAVYYCARGW APGGDAFDIW GQGTMVTVSS120

ASTKGPSVFP LAPSSKS                                              137

M27-B01             LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPYTFG QGTKLEIK            108

M27-B01             HC
EVQLLESGGG LVQPGGSLRL SCAASGFTFS DYTMWWVRQA PGKGLEWVSS ISSSGGITFY60

ADSVKGRFTI SRDNSKNTLY LQMNSLRAED TAVYYCARSA DTAMGGAFDI WGQGTMVTVS120

SASTKGPSVF PLAPSSKS                                             138

M27-B12             LC
QYELTQPPAV SVSPGQTATI TCSGDKLGDE YAAWYQQKPG QSPVLVIYQD RKRPSGIPER60

FSGSNFGNTA TLTITGTQVM DEADYYCQAW GKRNVVFGGG TKLTVL              106

M27-B12             HC
EVQLLESGGG LVQPGGSLRL SCAASGFTFS WYQMMWVRQA PGKGLEWVSS ISPSGGITEY60

ADSVKGRFTI SRDNSKNTLY LQMNSLRAED TAVYYCARDR SSGWYYYGMD VWGQGTTVTV120

SSASTKGPSV FPLAPSSKS                                            139

M27-E03             LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPRTFG QGTKVEIK            108

M27-E03             HC
EVQLLESGGG LVQPGGSLRL SCAASGFTFS SYMMHWVRQA PGKGLEWVSG IYPSGGWTDY60

ADSVKGRFTI SRDNSKNTLY LQMNSLRAED TATYYCARLV AGLDAFDIWG QGTMVTVSSA120

STKGPSVFPL APSSKS                                               136

M27-F04             LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPPTFG QGTKVEIK            108

M27-F04             HC
EVQLLESGGG LVQPGGSLRL SCAASGFTFS WYPMTWVRQA PGKGLEWVSS IGPSGGQTIY60

ADSVKGRFTI SRDNSKNTLY LQMNSLRAED TAVYYCTTEY GDYGGGFDPW GQGTLVTVSS120

ASTKGPSVFP LAPSSKS                                              137

M27-F11             LC
QDIQMTQSPS FLSASVGDRV TITCRASQGI SSYLAWYQQK PGKAPKLLIY AASSLQSGVP60
```

-continued

```
SRFSGSGSGT DFTLTISSLQ PEDFATYYCQ QSYNTLRTFG PGTKVDLK           108

M27-F11              HC
EVQLLESGGG LVQPGGSLRL SCAASGFTFS SYHMMWVRQA PGKGLEWVSS IYPSGGATMY60

ADSVKGRFTI SRDNSKNTLY LQMNSLRAED TAMYYCARDG YHYGDYTYFQ HWGQGTLVTV120

SSASTKGPSV FPLAPSSKS                                          139

M27-G01              LC
QDIQMTQSPS SLSASVGDRV TITCRASQSI STYLNWYQQK PGKAPKLLIY GASSLQSGVP60

SRFSGSGSGT DFTLTISSLQ PEDFTIYYCQ QSYSDPYTFG QGTKLDIK           108

M27-G01              HC
EVQLLESGGG LVQPGGSLRL SCAASGFTFS LYRMFWVRQA PGKGLEWVSS IWSSGGPTMY60

ADSVKGRFTI SRDNSKNTLY LQMNSLRAED TAVYYCAREY PSTYYFDYWG QGTLVTVSSA120

STKGPSVFPL APSSKS                                             136

M27-G04              LC
QDIQMTQSPS SLSASVGDRV TITCRASQRI SYYLTWYQQK PGKVPKLLIY AASSLESGVP60

SRFSGSGSGT DFTLTISNLQ PEDFATYYCQ QAFSTPFTFG GGTKVEIK           108

M27-G04              HC
EVQLLESGGG LVQPGGSLRL SCAASGFTFS AYYMVWVRQA PGKGLEWVSY ISPSGGQTQY60

ADSVKGRFTI SRDNSKNTLY LQMNSLRAED TAVYYCAREA ISSSSFDYWG QGTLVTVSSA120

STKGPSVFPL APSSKS                                             136

M27-G09              LC
QDIQMTQSPS SVSASVGDRI TITCRTRQSI SNYLNWYQQK PGEPPKLLIF AASSLQSGVP60

SRFSGSGTGT EFTLTISSLQ PEDLAIYYCQ QSYDIPFTFG QGTKLEIK           108

M27-G09              HC
EVQLLESGGG LVQPGGSLRL SCAASGFTFS EYDMAWVRQA PGKGLEWVSY IVSSGGFTSY60

ADSVKGRFTI SRDNSKNTLY LQMNSLRAED TAVYYCTTWA GWIAAADYWG QGTLVTVSSA120

STKGPSVFPL APSSKS                                             136

M27-H10              LC
QDIQMTQSPS SLSASVGDRV TITCRASQSI SNYLNWYQQK PGKAPKFLIY AASSLQSGVP60

SRFSGSGSGT DFTLSISSLQ PEDFATYYCQ QSYSTPQTFG QGTKVEMK           108

M27-H10              HC
EVQLLESGGG LVQPGGSLRL SCAASGFTFS AYQMAWVRQA PGKGLEWVSV IYSSGGYTDY60

ADSVKGRFTI SRDNSKNTLY LQMNSLRAED TAVYYCARHN WNDGAFDIWG QGTMVTVSSA120

STKGPSVFPL APSSKS                                             136

M28-A01              LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTLTFGG GTKVEIK            107

M28-A01              HC
EVQLLESGGG LVQPGGSLRL SCAASGFTFS WYAMHWVRQA PGKGLEWSG IYSSGGYTKY60

ADSVKGRFTI SRDNSKNTLY LQMNSLRAED TAVYYCARDL SNGDDVFDIW GQGTMVTVSS120

ASTKGPSVFP LAPSSKS                                            137

M28-C03              LC
QDIQMTQSPS SLSASVGDRV TITCRASQSI NFYLNWYQQK PGKAPKLLIY VASSLESGVP60

SRFSGSASGT EFTLTISSLQ PEDFATYYCL QSYSAPYTFG QGTKVEIT           108

M28-C03              HC
EVQLLESGGG LVQPGGSLRL SCAASGFTFS YYQMGWVRQA PGKGLEWSS IYPSGGMTDY60

ADSVKGRFTI SRDNSKNTLY LQMNSLRAED TAVYYCTRGS PWGDDAFDIW GQGTMVTVSS120

ASTKGPSVFP LAPSSKS                                            137
```

```
M28-D02              LC
QDIqMTQSPS SLSASEGDMV TITCRTSRRI GTYLNWYQQK PGKAPKLLIY GASSLQSGVP 60

SRFSGSGSGT DFTLTVSSLQ PEDVGTYYCQ QSFSSPWTFG PGTKVEIK             108

M28-D02              HC
EVQLLESGGG LVQPGGSLRL SCAASGFTFS WYPMQWVRQA PGKGLEWVSY IYPSGGGTDY 60

ADSVKGRFTI SRDNSKNTLY LQMNSLRAED TATYYCATSS GWLGDAFDIW GQGTMVTVSS 120

ASTKGPSVFP LAPSSKS                                               137

M28-D12              LC
QDIQMTQSPS SLSASVGDRV TITCRASQSI ATYLNWYQQK PGRAPKLLIY AASSLQSGVP 60

SRFVGGGSGS GTHFTLTISS LQPEDFATYY CQQSYSTRET FGQGTKVEIK           110

M28-D12              HC
EVQLLESGGG LVQPGGSLRL SCAASGFTFS WYTMHWVRQA PGKGLEWVSV IYPSGGPTSY 60

ADSVKGRFTI SRDNSKNTLY LQMNSLRAED TATYYCARDG SGSYLGFDYW GQGTLVTVSS 120

ASTKGPSVFP LAPSSKS                                               137

M28-E01              LC
QDIQMTQSPS SLSASVGDRV TITCRASQSI SSYLNWYQQK PGKAPKLLIY AASSLQSGVP 60

SKFSGSGSGT DYTLTISSLQ PEDFATYYCQ QTYTTPWTFG QGTKVEIK             108

M28-E01              HC
EVQLLESGGG LVQPGGSLRL SCAASGFTFS SYPMGWVRQA PGKGLEWVSR ISSSGGMTIY 60

ADSVKGRFTI SRDNSKNTLY LQMNSLRAED TAVYYCARDD WNVGMDVWGQ GTTVTVSSAS 120

TKGPSVFPLA PSSKS                                                 135

M28-E11              LC
QDIQMTQSPS SVSASVGDRV TINCRASQDI SNWLAWYQQK PGKAPNLLIY AASSLQTGAP 60

SRFSGSGSGT DFTLTISSLQ PEDFGTYVCQ QSYSLPWTFG LGTKVEVR             108

M28-E11              HC
EVQLLESGGG LVQPGGSLRL SCAASGFTFS LYDMTWVRQA PGKGLEWVSG ISSSGGVTIY 60

ADSVKGRFTI SRDNSKNTLY LQMNSLRAED TAVYYCARTY YYDSSGYADA FDIWGQGTMV 120

TVSSASTKGP SVFPLAPSSK S                                          141

M28-F01              LC
QDIQMTQSPS SLSASVGDRV TITCRASQSI NTYLNWYQQK PGKAPKVLIH AASTLESGVP 60

SRFSGSGSGT DFTLTISSLQ PEDFATYYCQ QSYSTPPTFG QGTKVEIK             108

M28-F01              HC
EVQLLESGGG LVQPGGSLRL SCAASGFTFS VYLMHWVRQA PGKGLEWVSG ISPSGGYTQY 60

ADSVKGRFTI SRDNSKNTLY LQMNSLRAED TAVYYCARPG GLDAFDIWGQ GTMVTVSSAS 120

TKGPSVFPLA PSSKS                                                 135

M28-F05              LC
QDIQMTQSPS SLSASVGDRV TITCRASQSI SSYLNWYQQK PGKAPKLLIY AASSLQSGVP 60

SRFSGSGSGT DFTLTISSLQ PEDFATYYCQ QSYSTPLTFG GGTKVEIK             108

M28-F05              HC
EVQLLESGGG LVQPGGSLRL SCAASGFTFS RYIMWWVRQA PGKGLEWVSG IYSSGGYTQY 60

ADSVKGRFTI SRDNSKNTLY LQMNSLRAED TAMYYCAREL EGLGGFDYWG QGTLVTVSSA 120

STKGPSVFPL APSSKS                                                136

M28-F07              LC
QDIQMTQSPS SVSASVGDRV TITCRASQGI SSWLAWYQQK PGKAPKLLIY ATSGLQSGVP 60

SRFSGSGSGT DFTLTISSLQ PEDFATYYCQ QAKSFPLTFG GGTRVEIK             108

M28-F07              HC
EVQLLESGGG LVQPGGSLRL SCAASGFTFS DYTMYWVRQA PGKGLEWVSS IVPSGGHTLY 60
```

-continued

```
ADSVKGRFTI SRDNSKNTLY LQMNSLRAED TAVYYCAKDH LSSWYGGFFD YWGQGTLVTV120

SSASTKGPSV FPLAPSSKS                                                139

M29-C07                LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTRYTFG QGTKLEIK                108

M29-C07                HC
EVQLLESGGG LVQPGGSLRL SCAASGFTFS GYDMMWVRQA PGKGLEWVSV ISSSGGNTAY60

ADSVKGRFTI SRDNSKNTLY LQMNSLRAED TAVYYCARES SGLYYFDYWG QGTLVTVSSA120

STKGPSVFPL APSSKS                                                   136

M29-D10                LC
QDIQMTQSPS SLSASVGDTV SITCRASQSI TIYLNWYQHK PGKAPNLLIY GASNLHSGVP60

SRFSGSGSGT DFTLTISSLQ PEDFATYYCQ QSYDTPLTFG GGTKVEIK                108

M29-D10                HC
EVQLLESGGG LVQPGGSLRL SCAASGFTFS WYPMYWVRQA PGKGLEWVSS IGSSGGPTPY60

ADSVKGRFTI SRDNSKNTLY LQMNSLRAED TAVYYCARWA DYGGSLDYWG QGTLVTVSSA120

STKGPSVFPL APSSKS                                                   136

M29-E02                LC
QSVLTQPPSV SEAPRQRVTI SCSGSSSNIG NNAVSWYQQL PGKAPKLLIY YDDLLPSGVS60

DRFSGSKSGT SASLAISGLR SEDEADYYCA AWDDSLNGFV FGTGTKVTVL             110

M29-E02                HC
EVQLLESGGG LVQPGGSLRL SCAASGFTFS RYPMMWVRQA PGKGLEWVSV IYPSGGDTFY60

ADSVKGRFTI SRDNSKNTLY LQMNSLRAED TAVYYCASGD DYLWEAAVYW GQGTLVTVSS120

ASTKGPSVFP LAPSSKS                                                  137

M29-G08                LC
QDIQMTQSPA TLSASPGETV TLSCRASQNI GNDVAWYRQR PGQAPRLLIH HASTRAYGIP60

ARLRGSGSAT EFTLTITSLE PEDFAIYYCQ QFYDWPAHTF ALGTRLEIKR             110

M29-G08                HC
EVQLLESGGG LVQPGGSLRL SCAASGFTFS YYHMWVRQA PGKGLEWVSG ISPSGGFTFY60

ADSVKGRFTI SRDNSKNTLY LQMNSLRAED TAVYYCARDY YDSSGYSPL GYWGQGTLVT120

VSSASTKGPS VFPLAPSSKS                                               140

M29-G10                LC
QDIQMTQSPS SLSSSVGDSA TITCRASQSI SIYLNWYQQK PGKAPKILIY GASQLESGVP60

SRFSGSGSGT DFTLTVSGLQ PEDFATYWCQ QSYNVPYTFG QGTKLEIK                108

M29-G10                HC
EVQLLESGGG LVQPGGSLRL SCAASGFTFS FYKMIWVRQA PGKGLEWVSS ISSSGGSTQY60

ADSVKGRFTI SRDNSKNTLY LQMNSLRAED TAVYYCARDR VDLGYLDYWG QGTLVTVSSA120

STKGPSVFPL APSSKS                                                   136

M74-A07                LC
QDIQMTQSPS SLSASVRDRV TITCRTSQNI NTYLNWYYQA PGRAPKLLIF GVSSLHRGVS60

SRFSGSGDGT EFTLTISSLQ PEDIGTYFCQ QSYSSPWTFG QGTKVEIK                108

M74-A07                HC
EVQLLESGGG LVQPGGSLRL SCAASGFTFS QYLMMWVRQA PGKGLEWVSS IYPSGGYTSY60

ADSVKGRFTI SRDNSKNTLY LQMNSLRAED TAVYYCARVS TAVADNDYWG QGTLVTVSSA120

STKGPSVFPL APSSKS                                                   136

M76-F02                LC
QDIQMTQSPS SLSASVGDRV TITCRASQTI DNYLHWYQQK PGKAPKVLIH DASSLQSGVP60

PRFSGSGSGT DFTLTISSLQ PEDFATYYCQ QSYDTPQYTF GQGTKLEIK               109
```

-continued

```
M76-F02                   HC
EVQLLESGGG LVQPGGSLRL SCAASGFTFS LYDMNWVRQA PGKGLEWVSG ISPSGGQTMY60

ADSVKGRFTI SRDNSKNTLY LQMNSLRAED TAVYYCARQP MISAFDIWGQ GTMVTVSSAS120

TKGPSVFPLA PSSKS                                              135

M76-G02                   LC
QDIQMTQSPS SLSASVGDRV TITCRASQSI SSYLNWYQQK PGKAPKLLIY AASSLQSGVP60

SRFSGSGSGT DFTLTISSLQ PEDFATYYCQ QSYSTPPWTF GQGTKVEIK         109

M76-G02                   HC
EVQLLESGGG LVQPGGSLRL SCAASGFTFS LYAMWWVRQA PGKGLEWVSY ISSSGGFTSY60

ADSVKGRFTI SRDNSKNTLY LQMNSLRAED TAVYYCARYR VGVAATDYWG QGTLVTVSSA120

STKGPSVFPL APSSKS                                             136

M76-G06                   LC
QDIQMTQSPS SLSASVRDRV TITCRASQSI STYLNWYQQK PGEAPKLLVF AASSLQSGVP60

SRFSGSGSGT DFTLSISSLQ PEDFATYYCQ QSYSTPHTFG QGAKVEIK          108

M76-G06                   HC
EVQLLESGGG LVQPGGSLRL SCAASGFTFS GYIMHWVRQA PGKGLEWVSW IYPSGGWTEY60

ADSVKGRFTI SRDNSKNTLY LQMNSLRAED TAVYYCARDA PGVGAIDYWG QGTLVTVSSA120

STKGPSVFPL APSSKS                                             136

M76-H02                   LC
QDIQMTQSPS SLSASEGDRV TITCRASQDI SVYLNWYQMK SGKAPKLLIY GGASLQSGVP60

ARFSGSGYGT DFTLTITDLR PEDFATYYCQ QSYSLPFTFG GGTKVEIK          108

M76-H02                   HC
EVQLLESGGG LVQPGGSLRL SCAASGFTFS MYWMQWVRQA PGKGLEWVSY IYPSGGPTKY60

ADSVKGRFTI SRDNSKNTLY LQMNSLRAED TAVYYCARPS GSYGDAFDIW GQGTMVTVSS120

ASTKGPSVFP LAPSSKS                                            137

M77-C07                   LC
QDIQMTQSPS TLSASVGDRV TITCRASQNI SSYLNWYQQK PGKAPKLLIY AASSLQSGVP60

SRFSGSGSGT DFTLTISSLQ PEDFATYSCQ QSYSTPRTFG QGTKVEIK          108

M77-C07                   HC
EVQLLESGGG LVQPGGSLRL SCAASGFTFS LYIMGWVRQA PGKGLEWVSG IYPSGGFTMY60

ADSVKGRFTI SRDNSKNTLY LQMNSLRAED TAVYYCARES SGVAAPDYWG QGTLVTVSSA120

STKGPSVFPL APSSKS                                             136

M77-H04                   LC
QDIQMTQSPL SLPVTPGEPA SISCRSSQSL LHSRGYNYLD WYLQKPGQSP QLLIYLGSNR60

ASGVPDRFSG SGSGTDFTLK ISRVEAEDVG VYYCMQALQR RTFGQGTKLE IK      112

M77-H04                   HC
EVQLLESGGG LVQPGGSLRL SCAASGFTFS YYTMIWVRQA PGKGLEWVSG IRSSGGGTRY60

ADSVKGRFTI SRDNSKNTLY LQMNSLRAED TAVYYCAKDG SRYSYGSIYY YYGMDAWGQG120

TTVTVSSAST KGPSVFPLAP SSKS                                    144
```

Example 2

Lead Antibody Inhibitors

Antibodies were selected as lead plasma kallikrein inhibitors on the basis of apparent inhibition constant ($K_{i,app}$), specificity with respect to lack of inhibition of other serine proteases, inhibition of bradykinin generation, and lack of binding to plasma prekallikrein (Table 3). Plasma kallikrein circulates in the plasma as an inactive zymogen (prekallikrein) at a concentration of approximately 500 nM. Antibodies that bound prekallikrein may be rendered inaccessible towards active plasma kallikrein inhibition and could substantially increase the in vivo dose required for efficacy. Therefore, a surface plasmon resonance (SPR) assay was used to identify antibodies that do not bind prekallikrein (data not shown). Specifically, human IgGs (X81-B01, M162-A04 (R84-H05); M160-G12 (R84-D02); and M142-H08) were captured on a CM5 chip using an anti-human Fc surface and 100 nM of plasma kallikrein or 100 nM or 500 nM prekallikrein. The prekallikrein was treated with aprotinin-sepharose to remove active plasma kallikrein. The prekallikrein used for X81-B01 was buffer exchanged into the exact preparation of SPR running buffer (HEPES buffered saline) to avoid the refractive index shift that was observed with three other antibodies that were tested: M162-A04 (R84-H05); M160-G12 (R84-D02); and M142-H08.

Of the antibodies listed in Table 3, only M142-H08 inhibits human plasma kallikrein with a subnanomolar $K_{i,app}$. However, when M142-H08 was produced as an IgG it was found to be cleaved in the CDR3 of the heavy chain. Consequently, we decided to undertake two approaches to improve the affinity: 1) affinity maturation of M162-A04 and M160-G12 using a novel form of light chain shuffling called ROLIC (Rapid Optimization of Light Chains) (see, e.g., WO 2009/102927 and U.S. 2009-0215119); and 2) sequence optimization of M142-H08 in order to prevent the cleavage of the IgG that occurs while retaining the binding and inhibitor properties of M142-H08.

TABLE 3

Top Ranking Antibody Inhibitors of PKal Before Affinity Maturation or Sequence Optimization

| Criteria | M162-A04 | M160-G12 | M142-H08[a] |
|---|---|---|---|
| $K_{i,app}$ human pKal | 2 nM (as an IgG) | 5.6 nM (as an IgG) | 0.6 nM (as a Fab) |
| $K_{i,app}$ rodent pKal | 2 nM (mouse and rat) | <1 nM (mouse) | ~1 nM (mouse and rat) |
| Binds prekallikrein? | No | No | No |
| Specific inhibitor with respect to fXIa, plasmin, and trypsin | Yes | Yes | Yes |
| Inhibits bradykinin generation | Yes | Yes | Yes |

[a]When M142-H08 was produced as an IgG it was determined to be cleaved in the CDR3 of its heavy chain (GGLLLWFR-ELKSNYFDY).

Example 3

Sequence Optimization of M142-H08

Of the antibodies listed in Table 3, only M142-H08 inhibits human pKal with a subnanomolar $K_{i,app}$. However, when M142-H08 was produced as an IgG it was found to be cleaved in the CDR3 of the heavy chain. M142-H08 was found by mass spectrometry to be cleaved after the arginine in the "WFR" sequence of the HC-CDR3 sequence (GGLLLW-FRELKSNYFDY (SEQ ID NO:894)). This cleavage suggests that a protease from the cells used to express the antibody (both CHO and 293T human kidney cells) is enzymatically cleaving the antibody at a single specific site. We mutated the HC-CDR3 sequence of M142-H08 in order to identify amino acid substitutions that prevent the cleavage of the IgG that occurs while retaining the binding and inhibitor properties of M142-H08. Previous experience with similarly "clipped" antibodies suggested that focusing simply on the putative P1 position (protease subsite 1, see Table 4) may not be sufficient to identify antibodies that retain potent inhibition of the target enzyme while not being clipped by a host cell protease. Therefore, we created a small library of single point mutations in the region around the cleavage site in order to identify variants of M142-H08 that are not clipped but are still potent pKal inhibitors. We refer to this library as the "CDR3 by Design" library. The small library was constructed using a PCR primer that contains the randomized codon NNK at either the P3, the P2, the P1, or the P1' site. This results in a small library where each of the 4 positions may contain any of the 20 amino acids (20+20+20+20=80 members). Using PCR, this library was cloned into the M142-H08Fab sequence in the pMid21 vector, which is a standard phagemid vector.

TABLE 4

Primer sequences

| Primer Name | Sequence | | | | | | | | | | N |
|---|---|---|---|---|---|---|---|---|---|---|---|
| | | | | | | P3 | P2 | P1 | P1' | P2' | |
| (SEQ ID NO: 895) | G | G | L | L | L | W | F | R | E | L | K |
| | S | N | Y | | | | | | | | |
| 559A.P1.top (SEQ ID NO: 896) | GGC GGT CTA TTA CTA TGG TTC NNK GAG CTG AAG TCT AAC TAC | | | | | | | | | | 20 |
| 559A.P2.top (SEQ ID NO: 897) | GGC GGT CTA TTA CTA TGG NNK AGG GAG CTG AAG TCT AAC TAC | | | | | | | | | | 20 |
| 559A.P3.top (SEQ ID NO: 898) | GGC GGT CTA TTA CTA NNK TTC AGG GAG CTG AAG TCT AAC TAC | | | | | | | | | | 20 |
| 559A.P1p.top (SEQ ID NO: 899) | GGC GGT CTA TTA CTA TGG TTC AGG NNK CTG AAG TCT AAC TAC | | | | | | | | | | 20 |

By DNA sequencing, we recovered 61 of the possible 80 antibodies (Table 5). These antibodies were produced as Fab fragments in small scale (~20 μg) and tested for inhibition against human pKal in an in vitro protease cleavage assay using Pro-Phe-Arg-aminomethylcoumarin as the synthetic peptide substrate. The Fabs that were found to be inhibitors of human pKal were subcloned into our pBRH1f vector (a vector for transient expression of IgGs in 293T cells) for conversion to full length human IgG1 antibodies. Five antibodies were then expressed in 293T cells and purified by protein A sepharose chromatography. The antibodies were analyzed by SDS-PAGE to determine which of the inhibitory mutants are not cleaved by the host cell protease(s) (data not shown). The cleaved antibodies (559A-X67-G05, 559A-X67-H01, 559A-X67-G09) had an extra band that migrated between the 38 and the 49 kDa molecular weight marker. This band is absent in the 559A-X67-H04 and 559A-X67-D03 antibodies, which indicates that these antibodies are intact.

$K_{i,app}$ values were determined by steady state enzyme kinetics for those that were shown by SDS-PAGE to be not cleaved (Table 5). Interestingly, the P2 position was the only position where amino acid substitutions yielded intact antibody inhibitors of pKal. Of the 14 different mutations that were recovered at the P3 position (Table 5), only one mutant (W to L) was found to be a pKal inhibitor as a Fab but it was subsequently shown to be clipped as an IgG. None of the 16 different mutations at the P1 position (Table 5) were found to be pKal inhibitors. Eight of the 15 different mutations at the P1' position were found to be inhibitors of pKal as a Fab but all were clipped as an IgG. Consequently, only mutations at the P2 position led to antibody inhibitors that were not clipped during expression. Of the 16 different mutations that were recovered at the P2 position (Table 5), eight mutants were found to be a pKal inhibitor as a Fab but it was subsequently shown to be clipped as an IgG. Four mutants at the P2 position were found to have subnanomolar $K_{i,app}$ values: X67-G04 (F to A), X67-C03 (F to M), X67-F01 (F to Q) and X67-D03 (F to N). The antibody with the highest potency is X67-D03 ($K_{i,app}$=0.1 nM). The two antibodies shown in Table 6 were not cleaved when expressed as IgGs and were found to inhibit pKal with a subnanomolar $K_{i,app}$.

DNA and amino acid sequence alignments of the light chains of nongermlined (X63-G06) and germlined, codon optimized (X81-B01) versions of the same antibody discovered using ROLIC affinity maturation are shown in FIGS. 4 and 5, respectively. DNA and amino acid sequence alignments of the heavy chains of nongermlined (X63-G06) and germlined, codon optimized (X81-B01) versions of the same antibody discovered using ROLIC affinity maturation are shown in FIGS. 6 and 7, respectively.

TABLE 5

HV-CDR3 Sequences Obtained from "CDR3 by Design" Library*

| Mutation Site | Antibody I.D. | HV-CDR3 (SEQ ID NOs: 900-961) | Inhibit as a Fab? | Intact as an IgG? | Ki, app as an IgG (nM) |
|---|---|---|---|---|---|
| Parental | X69-C09 | GGLLLWFRELKSNYFDY | Yes | No | 0.2 |
| P3 | X68-E07 | GGLLLAFRELKSNYFDY | No | n/a | n/a |
| P3 | X68-E12 | GGLLLCFRELKSNYFDY | No | n/a | n/a |
| P3 | X68-A03 | GGLLLDFRELKSNYFDY | No | n/a | n/a |
| P3 | X68-E03 | GGLLLEFRELKSNYFDY | No | n/a | n/a |
| P3 | X68-A12 | GGLLLGFRELKSNYFDY | No | n/a | n/a |
| P3 | X68-D11 | GGLLLKFRELKSNYFDY | No | n/a | n/a |
| P3 | X68-E01 | GGLLLLFRELKSNYFDY | Yes | No | n/a |
| P3 | X68-F05 | GGLLLMFRELKSNYFDY | No | n/a | n/a |
| P3 | X68-D10 | GGLLLPFRELKSNYFDY | No | n/a | n/a |
| P3 | X68-F10 | GGLLLQFRELKSNYFDY | No | n/a | n/a |
| P3 | X68-G01 | GGLLLRFRELKSNYFDY | No | n/a | n/a |
| P3 | X68-G05 | GGLLLSFRELKSNYFDY | No | n/a | n/a |
| P3 | X68-F12 | GGLLLTFRELKSNYFDY | No | n/a | n/a |
| P3 | X68-H04 | GGLLLVFRELKSNYFDY | No | n/a | n/a |
| P2 | X67-G04 | GGLLLWARELKSNYFDY | Yes | Yes | 0.35 |
| P2 | X67-G01 | GGLLLWCRELKSNYFDY | No | n/a | n/a |
| P2 | X67-E04 | GGLLLWDRELKSNYFDY | Yes | Yes | 1.3 |
| P2 | X67-H04 | GGLLLWERELKSNYFDY | Yes | Yes | 3.6 |
| P2 | X67-C09 | GGLLLWGRELKSNYFDY | Yes | Yes | 8.6 |
| P2 | X67-B04 | GGLLLWKRELKSNYFDY | Yes | No | n/a |

TABLE 5-continued

HV-CDR3 Sequences Obtained from "CDR3 by Design" Library*

| Mutation Site | Antibody I.D. | HV-CDR3 (SEQ ID NOs: 900-961) | Inhibit as a Fab? | Intact as an IgG? | Ki, app as an IgG (nM) |
|---|---|---|---|---|---|
| P2 | X67-G09 | GGLLLWLRELKSNYFDY | Yes | No | n/a |
| P2 | X67-C03 | GGLLLWMRELKSNYFDY | Yes | Yes | 0.7 |
| P2 | X67-D03 | GGLLLWNRELKSNYFDY | Yes | Yes | 0.1 |
| P2 | X67-B05 | GGLLLWPRELKSNYFDY | No | n/a | n/a |
| P2 | X67-F01 | GGLLLWQRELKSNYFDY | Yes | Yes | 0.9 |
| P2 | X67-G05 | GGLLLWRRELKSNYFDY | Yes | No | n/a |
| P2 | X67-B03 | GGLLLWSRELKSNYFDY | Yes | Yes | 2.1 |
| P2 | X67-F10 | GGLLLWTRELKSNYFDY | Yes | Yes | 1.3 |
| P2 | X67-H01 | GGLLLWWRELKSNYFDY | Yes | No | n/a |
| P2 | X67-F08 | GGLLLWYRELKSNYFDY | Yes | No | n/a |
| P1 | X66-E09 | GGLLLWFAELKSNYFDY | No | n/a | n/a |
| P1 | X66-B05 | GGLLLWFCELKSNYFDY | No | n/a | n/a |
| P1 | X66-D03 | GGLLLWFEELKSNYFDY | No | n/a | n/a |
| P1 | X66-H04 | GGLLLWFFELKSNYFDY | No | n/a | n/a |
| P1 | X66-H02 | GGLLLWFGELKSNYFDY | No | n/a | n/a |
| P1 | X66-C11 | GGLLLWFHELKSNYFDY | No | n/a | n/a |
| P1 | X66-A07 | GGLLLWFKELKSNYFDY | No | n/a | n/a |
| P1 | X66-C03 | GGLLLWFLELKSNYFDY | No | n/a | n/a |
| P1 | X66-G05 | GGLLLWFMELKSNYFDY | No | n/a | n/a |
| P1 | X66-F10 | GGLLLWFPELKSNYFDY | No | n/a | n/a |
| P1 | X66-E04 | GGLLLWFQELKSNYFDY | No | n/a | n/a |
| P1 | X66-F01 | GGLLLWFSELKSNYFDY | No | n/a | n/a |
| P1 | X66-H11 | GGLLLWFTELKSNYFDY | No | n/a | n/a |
| P1 | X66-C02 | GGLLLWFVELKSNYFDY | No | n/a | n/a |
| P1 | X66-F09 | GGLLLWFWELKSNYFDY | No | n/a | n/a |
| P1 | X66-G08 | GGLLLWFYELKSNYFDY | No | n/a | n/a |
| P1' | X69-D08 | GGLLLWFRALKSNYFDY | No | n/a | n/a |
| P1' | X69-B02 | GGLLLWFRCLKSNYFDY | No | n/a | n/a |
| P1' | X69-D09 | GGLLLWFRGLKSNYFDY | Yes | No | n/a |
| P1' | X69-D02 | GGLLLWFRHLKSNYFDY | No | n/a | n/a |
| P1' | X69-A12 | GGLLLWFRKLKSNYFDY | No | n/a | n/a |
| P1' | X69-F05 | GGLLLWFRLLKSNYFDY | Yes | No | n/a |
| P1' | X69-B08 | GGLLLWFRNLKSNYFDY | Yes | No | n/a |
| P1' | X69-A10 | GGLLLWFRPLKSNYFDY | No | n/a | n/a |
| P1' | X69-A09 | GGLLLWFRQLKSNYFDY | Yes | No | n/a |
| P1' | X69-E05 | GGLLLWFRRLKSNYFDY | No | n/a | n/a |

TABLE 5-continued

HV-CDR3 Sequences Obtained from "CDR3 by Design" Library*

| Mutation Site | Antibody I.D. | HV-CDR3 (SEQ ID NOs: 900-961) | Inhibit as a Fab? | Intact as an IgG? | Ki, app as an IgG (nM) |
|---|---|---|---|---|---|
| P1' | X69-F09 | GGLLLWFRSLKSNYFDY | Yes | No | n/a |
| P1' | X69-F01 | GGLLLWFRTLKSNYFDY | Yes | No | n/a |
| P1' | X69-C12 | GGLLLWFRVLKSNYFDY | Yes | No | n/a |
| P1' | X69-E01 | GGLLLWFRWLKSNYFDY | Yes | No | n/a |
| P1' | X69-H10 | GGLLLWFRYLKSNYFDY | No | n/a | n/a |

*All of these antibodies are single point mutations of the M142-H08 sequence.

Amino Acid Sequences of Light Chain (LC) and Heavy Chain (HC) Variable Domain of pKal Antibodies with Designed HC CDR3s are Shown Below. (SEQ ID NOs: 962-1085)

```
X68-E07 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X68-E07 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLAFRELKS NYFDYWGQGT   120

LVTVSSASTK GPSVFPLAPS SKS                                          143

X68-E12 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X68-E12 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLCFRELKS NYFDYWGQGT   120

LVTVSSASTK GPSVFPLAPS SKS                                          143

X68-A03 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X68-A03 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLDFRELKS NYFDYWGQGT   120

LVTVSSASTK GPSVFPLAPS SKS                                          143

X68-E03 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X68-E03 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLEFRELKS NYFDYWGQGT   120

LVTVSSASTK GPSVFPLAPS SKS                                          143

X68-A12 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108
```

```
X68-A12 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLGFRELKS NYFDYWGQGT  120

LVTVSSASTK GPSVFPLAPS SKS                                         143

X68-D11 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-D11 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLKFRELKS NYFDYWGQGT  120

LVTVSSASTK GPSVFPLAPS SKS                                         143

X68-E01 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-E01 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLLFRELKS NYFDYWGQGT  120

LVTVSSASTK GPSVFPLAPS SKS                                         143

X68-F05 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-F05 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLMFRELKS NYFDYWGQGT  120

LVTVSSASTK GPSVFPLAPS SKS                                         143

X68-D10 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-D10 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLPFRELKS NYFDYWGQGT  120

LVTVSSASTK GPSVFPLAPS SKS                                         143

X68-F10 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-F10 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLQFRELKS NYFDYWGQGT  120

LVTVSSASTK GPSVFPLAPS SKS                                         143

X68-G01 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-G01 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLRFRELKS NYFDYWGQGT  120

LVTVSSASTK GPSVFPLAPS SKS                                         143

X68-G05 LC
```

```
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR              108

X68-G05 HC
EVQLLESGGG LVQPGGSLRL SCAASGFTFS AYSMIWVRQA PGKGLEWVSY IRPSGGRTTY   60

ADSVKGRFTI SRDNSKNILY LQMNSLRAED TAVYYCARGG LLLSFRELKS NYFDYWGQGT  120

LVTVSSASTK GPSVFPLAPS SKS                                        143

X68-F12 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-F12 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLTFRELKS NYFDYWGQGT  120

LVTVSSASTK GPSVFPLAPS SKS                                        143

X68-H04 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X68-H04 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLVFRELKS NYFDYWGQGT  120

LVTVSSASTK GPSVFPLAPS SKS                                        143

X67-G04 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X67-G04 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWARELKS NYFDYWGQGT  120

LVTVSSASTK GPSVFPLAPS SKS                                        143

X67-G01 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X67-G01 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWCRELKS NYFDYWGQGT  120

LVTVSSASTK GPSVFPLAPS SKS                                        143

X67-E04 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X67-E04 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWDRELKS NYFDYWGQGT  120

LVTVSSASTK GPSVFPLAPS SKS                                        143

X67-H04 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR              108

X67-H04 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWERELKS NYFDYWGQGT  120
```

```
                                  -continued
LVTVSSASTK GPSVFPLAPS SKS                                              143

X66-E09 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-E09 HC
EVQLLESGGG LVQPGGSLRL SCAASGFTFS AYSMIWVRQA PGKGLEWVSY IRPSGGRTTY        60

ADSVKGRFTI SRDNSKNTLY LQMNSLRAED TAVYYCARGG LLLWFAELKS NYFDYWGQGT       120

LVTVSSASTK GPSVFPLAPS SKS                                              143

X66-B05 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-B05 HC
EVQLLESGGG LVQPGGSLRL SCAASGFTFS AYSMIWVRQA PGKGLEWVSY IRPSGGRTTY        60

ADSVKGRFTI SRDNSKNTLY LQMNSLRAED TAVYYCARGG LLLWFCELKS NYFDYWGQGT       120

LVTVSSASTK GPSVFPLAPS SKS                                              143

X66-D03 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-D03 HC
EVQLLESGGG LVQPGGSLRL SCAASGFTFS AYSMIWVRQA PGKGLEWVSY IRPSGGRTTY        60

ADSVKGRFTI SRDNSKNTLY LQMNSLRAED TAVYYCARGG LLLWFEELKS NYFDYWGQGT       120

LVTVSSASTK GPSVFPLAPS SKS                                              143

X66-H04 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-H04 HC
EVQLLESGGG LVQPGGSLRL SCAASGFTFS AYSMIWVRQA PGKGLEWVSY IRPSGGRTTY        60

ADSVKGRFTI SRDNSKNTLY LQMNSLRAED TAVYYCARGG LLLWFFELKS NYFDYWGQGT       120

LVTVSSASTK GPSVFPLAPS SKS                                              143

X66-H02 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-H02 HC
EVQLLESGGG LVQPGGSLRL SCAASGFTFS AYSMIWVRQA PGKGLEWVSY IRPSGGRTTY        60

ADSVKGRFTI SRDNSKNTLY LQMHSLRAED TAVYYCARGG LLLWFGELKS NYFDYWGQGT       120

LVTVSSASTK GPSVFPLAPS SKS                                              143

X66-C11 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-C11 HC
EVQLLESGGG LVQPGGSLRL SCAASGFTFS AYSMIWVRQA PGKGLEWVSY IRPSGGRTTY        60

ADSVKGRFTI SRDNSKNTLY LQMNSLRAED TAVYYCARGG LLLWFHELKS NYFDYWGQGT       120

LVTVSSASTK GPSVFPLAPS SKS                                              143

X66-A07 LC
QDIQMTQSPS SLSAFVGDRV TITCRASQPI DNYLNWYHQK PGKAPKLLIY AASRLQSGVP        60

SRLSGSGFGT DFTLTISSLQ PEDFGNYYCQ QSYTVPYTFG GGTKVEIR                    108

X66-A07 HC
EVQLLESGGG LVQPGGSLRL SCAASGFTFS AYSMIWVRQA PGKGLEWVSY IRPSGGRTTY        60
```

```
ADSVKGRFTI SRDNSKNTLY LQMNSLRAED TAVYYCARGG LLLWFKELKS NYFDYWGQGT    120

LVTVSSASTK GPSVFPLAPS SKS                                           143

X66-C03 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X66-C03 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFLELKS NYFDYWGQGT    120

LVTVSSASTK GPSVFPLAPS SKS                                           143

X66-G05 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X66-G05 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFMELKS NYFDYWGQGT    120

LVTVSSASTK GPSVFPLAPS SKS                                           143

X66-F10 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X66-F10 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFPELKS NYFDYWGQGT    120

LVTVSSASTK GPSVFPLAPS SKS                                           143

X66-E04 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X66-E04 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFQELKS NYFDYWGQGT    120

LVTVSSASTK GPSVFPLAPS SKS                                           143

X69-D08 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X69-D08 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFRALKS NYFDYWGQGT    120

LVTVSSASTK GPSVFPLAPS SKS                                           143

X69-B02 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108

X69-B02 HC
EVQLLESGGG LVQPGGSLRL SCAASGFTFS AYSMIWVRQA PGKGLEWVSY IRPSGGRTTY     60

ADSVKGRFTI SRDNSKNTLY LQMNSLRAED TAVYYCARGG LLLWFRCLKS NYFDYWGQGT    120

LVTVSSASTK GPSVFPLAPS SKS                                           143

X69-C09 LC
QDIQMTQSPS SLSAFVGDRV TITCRASQPI DNYLNWYHQK PGKAPKLLIY AASRLQSGVP     60

SRLSGSGFGT DFTLTISSLQ PEDFGNYYCQ QSYTVPYTFG GGTKVEIR                 108
```

-continued

```
X69-C09 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRELKS NYFDYWGQGT   120

LVTVSSASTK GPSVFPLAPS SKS                                          143

X69-D09 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-D09 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRGLKS NYFDYWGQGT   120

LVTVSSASTK GPSVFPLAPS SKS                                          143

X69-D02 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-D02 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRHLKS NYFDYWGQGT   120

LVTVSSASTK GPSVFPLAPS SKS                                          143

X69-A12 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-A12 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRKLKS NYFDYWGQGT   120

LVTVSSASTK GPSVFPLAPS SKS                                          143

X69-F05 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-F05 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRLLKS NYFDYWGQGT   120

LVTVSSASTK GPSVFPLAPS SKS                                          143

X69-B08 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-B08 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRNLKS NYFDYWGQGT   120

LVTVSSASTK GPSVFPLAPS SKS                                          143

X69-A10 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-A10 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRPLKS NYFDYWGQGT   120

LVTVSSASTK GPSVFPLAPS SKS                                          143

X69-A09 LC
```

-continued

```
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-A09 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRQLKS NYFDYWGQGT   120

LVTVSSASTK GPSVFPLAPS SKS                                          143

X69-E05 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-E05 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRRLKS NYFDYWGQGT   120

LVTVSSASTK GPSVFPLAPS SKS                                          143

X69-F09 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-F09 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRSLKS NYFDYWGQGT   120

LVTVSSASTK GPSVFPLAPS SKS                                          143

X69-F01 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-F01 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRTLKS NYFDYWGQGT   120

LVTVSSASTK GPSVFPLAPS SKS                                          143

X69-C12 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-C12 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRVLKS NYFDYWGQGT   120

LVTVSSASTK GPSVFPLAPS SKS                                          143

X69-E01 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-E01 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRWLKS NYFDYWGQGT   120

LVTVSSASTK GPSVFPLAPS SKS                                          143

X69-H10 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X69-H10 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWFRYLKS NYFDYWGQGT   120
```

-continued

```
LVTVSSASTK GPSVFPLAPS SKS                                          143

X66-F01 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X66-F01 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWFSELKS NYFDYWGQGT  120

LVTVSSASTK GPSVFPLAPS SKS                                          143

X66-H11 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X66-H11 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWFTELKS NYFDYWGQGT  120

LVTVSSASTK GPSVFPLAPS SKS                                          143

X66-C02 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X66-C02 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWFVELKS NYFDYWGQGT  120

LVTVSSASTK GPSVFPLAPS SKS                                          143

X66-F09 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X66-F09 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWFWELKS NYFDYWGQGT  120

LVTVSSASTK GPSVFPLAPS SKS                                          143

X66-G08 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X66-G08 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWFYELKS NYFDYWGQGT  120

LVTVSSASTK GPSVFPLAPS SKS                                          143

X67-C09 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X67-C09 HC
EVQLLESGGG LVQPGGSLRL SCAASGFTFS AYSMIWVRQA PGKGLEWVSY IRPSGGRTTY   60

ADSVKGRFTI SRDNSKNTLY LQMNSLRAED TAVYYCARGG LLLWGRELKS NYFDYWGQGT  120

LVTVSSASTK GPSVFPLAPS SKS                                          143

X67-B04 LC
QDIQMTQSPS SLSAFVGDRV TITCRASQPI DNYLNWYHQK PGKAPKLLIY AASRLQSGVP   60

SRLSGSGFGT DFTLTISSLQ PEDFGNYYCQ QSYTVPYTFG GGTKVEIR               108

X67-B04 HC
EVQLLESGGG LVQPGGSLRL SCAASGFTFS AYSMIWVRQA PGKGLEWVSY IRPSGGRTTY   60
```

-continued

```
ADSVKGRFTI SRDNSKNTLY LQMNSLRAED TAVYYCARGG LLLWKRELKS NYFDYWGQGT      120

LVTVSSASTK GPSVFPLAPS SKS                                             143

X67-G09 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-G09 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWLRELKS NYFDYWGQGT      120

LVTVSSASTK GPSVFPLAPS SKS                                             143

X67-C03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-C03 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWMRELKS NYFDYWGQGT      120

LVTVSSASTK GPSVFPLAPS SKS                                             143

X67-D03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-D03 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWNRELKS NYFDYWGQGT      120

LVTVSSASTK GPSVFPLAPS SKS                                             143

X67-B05 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-B05 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWPRELKS NYFDYWGQGT      120

LVTVSSASTK GPSVFPLAPS SKS                                             143

X67-F01 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-F01 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWQRELKS NYFDYWGQGT      120

LVTVSSASTK GPSVFPLAPS SKS                                             143

X67-G05 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

X67-G05 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWRRELKS NYFDYWGQGT      120

LVTVSSASTK GPSVFPLAPS SKS                                             143

X67-B03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108
```

```
X67-B03 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWSRELKS NYFDYWGQGT   120

LVTVSSASTK GPSVFPLAPS SKS                                           143

X67-F10 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X67-F10 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWTRELKS NYFDYWGQGT   120

LVTVSSASTK GPSVFPLAPS SKS                                           143

X67-H01 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X67-H01 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWWRELKS NYFDYWGQGT   120

LVTVSSASTK GPSVFPLAPS SKS                                           143

X67-F08 LC
QDIQMTQSPS SLSAFVGDRV TITCRASQPI DNYLNWYHQK PGKAPKLLIY AASRLQSGVP    60

SRLSGSGFGT DFTLTISSLQ PEDFGNYYCQ QSYTVPYTFG GGTKVEIR                108

X67-F08 HC
EVQLLESGGG LVQPGGSLRL SCAASGFTFS AYSMIWVRQA PGKGLEWVSY IRPSGGRTTY    60

ADSVKGRFTI SRDNSKNTLY LQMNSLRAED TAVYYCARGG LLLWYRELKS NYFDYWGQGT   120

LVTVSSASTK GPSVFPLAPS SKS                                           143
```

TABLE 6

CDR Amino Acid Sequences of Optimized Antibody Inhibitor of pKal Based on M142-H08 (SEQ ID NOs: 1086-1092)

| Initial Name | Ki, app (nM) of IgG | LV-CDR1 (SEQ ID NO: 1086) | LV-CDR2 (SEQ ID NO: 1087) | LV-CDR3 (SEQ ID NO: 1088) | HV-CDR1 (SEQ ID NO: 1088) | HV-CDR2 (SEQ ID NO: 1090) | HV-CDR3[a] (SEQ ID NOs: 1091 and 1092) |
|---|---|---|---|---|---|---|---|
| X67-D03 | 0.1 | RASQPIDNYLN | AASRLQS | QQSYTVPYT | AYSMI | YIRPSGGRTTYADSVKG | GGLLLWNRELKSNYFDY |
| X67-G04 | 0.35 | RASQPIDNYLN | AASRLQS | QQSYTVPYT | AYSMI | YIRPSGGRTTYADSVKG | GGLLLWARELKSNYFDY |

[a]The F to N substitution (in bold) in the CDR3 of the M142-H08 gives X67-D03, an IgG that is not cleaved during expression and is a potent inhibitor of human. Similarly, the F to A substitution gives X67-G04, which is also not cleaved.

TABLE 7

CDR Amino Acid Sequences of Affinity Matured Antibody Inhibitors of pKal Discovered using ROLIC (SEQ ID NOs: 1093-1113)

| Initial Name | Ki, app (nM) | LV-CDR1 (SEQ ID NOs: 1093-1098) | LV-CDR2 (SEQ ID NOs: 1099-1104) | LV-CDR3 (SEQ ID NOs: 1105-1110) | HV-CDR1 (SEQ ID NO: 1111) | HV-CDR2 (SEQ ID NO: 1112) | HV-CDR3 (SEQ ID NO: 1113) |
|---|---|---|---|---|---|---|---|
| X59-C07 | 6.1 | RAGRSISTYVN | AASSLQS | QQSQSTPYT | HYLMT | YISPSGGHTIYADS-VKG | VARGIAARSRTSYFDY |

TABLE 7-continued

CDR Amino Acid Sequences of Affinity Matured Antibody Inhibitors of pKal Discovered using ROLIC (SEQ ID NOs: 1093-1113)

| Initial Name | Ki, app (nM) | LV-CDR1 (SEQ ID-NOs: 1093-1098) | LV-CDR2 (SEQ ID NOs: 1099-1104) | LV-CDR3 (SEQ ID NOs: 1105-1110) | HV-CDR1 (SEQ ID NO: 1111) | HV-CDR2 (SEQ ID NO: 1112) | HV-CDR3 (SEQ ID NO: 1113) |
|---|---|---|---|---|---|---|---|
| X60-D01 | 2.0 | RASQIVSSRYLA | GAASRAT | QQTYSSPFT | HYLMT | YISPSGGHTIYADSVKG | VARGIAARSRTSYFDY |
| X63-G10 | 9.0 | RASQSISNYLN | AASSLQS | QQSYTSPYT | HYLMT | YISPSGGHTIYADSVKG | VARGIAARSRTSYFDY |
| X64-F04 | 1.9 | RASQIVSSNYLA | GASNRAT | QQSFNIPYT | HYLMT | YISPSGGHTIYADSVKG | VARGIAARSRTSYFDY |
| X63-G06 | 0.4 (Fab) | RTSQFVNSNYLA | GASSRAT | QQSSRTPWT | HYLMT | YISPSGGHTIYADSVKG | VARGIAARSRTSYFDY |
| X81-B01[a] | 0.2 (IgG) | RTSQFVNSNYLA | GASSRAT | QQSSRTPWT | HYLMT | YISPSGGHTIYADSVKG | VARGIAARSRTSYFDY |

[a]X81-B01 is the codon optimized and germlined version of X63-G06 as a full length human IgG produced in HEK 293T cells.

Amino Acid Sequences of Light Chain (LC) and Heavy Chain (HC) Variable Domain of Affinity Matured Antibody Inhibitors of pKal Discovered Using ROLIC are Shown Below (SEQ ID NOs:1114-1123).

```
X59-C07 LC
QDIQMTQSPS SLSASVGDRV TVTCRAGRSI STYVNWYQQK PGKAPKLLIY AASSLQSGVP    60

SRFSGSRSGT DFTLTISSLQ PEDFATYYCQ QSQSTPYTFG QGTKLEVK                 108

X59-C07 HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDYWGQGTL    120

VTVSSASTKG PSVFPLAPSS KS                                             142

X60-D01 LC
QDIQMTQSPG TLSLSPGERA TLSCRASQIV SSRYLAWYQQ RPGQAPRLLI YGAASRATGI    60

PDRFSGSGSG TDFTLTISSL QAEDFATYYC QQTYSSPFTF GQGTKMEIK                109

X60-D01 HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDYWGQGTL    120

VTVSSASTKG PSVFPLAPSS KS                                             142

X63-G06 LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK                109

X63-G06 HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDYWGQGTL    120

VTVSSASTKG PSVFPLAPSS KS                                             142

X63-G10 LC
QDIQMTQSPD SLSASVGDRV TITCRASQSI SNYLNWYQQK PGKAPKLLIY AASSLQSGVP    60

SRFSGSGSGT DFTLTISGLQ PEDFASYYCQ QSYTSPYTFV QGTKLEIKRT               110

X63-G10 HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDYWGQGTL    120
```

```
                           -continued
VTVSSASTKG PSVFPLAPSS KS                                           142

X64-F04 LC
QDIQMTQSPA TLSLSPGERA TLSCRASQIV SSNYLAWYQQ KPGQAPRLLI YGASNRATGI    60

PDRFSGSGSG TEFTLTISSL QSEDFAIYYC QQSFNIPYTF GQGTRVDIK              109

X64-F04 HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDYWGQGTL  120

VTVSSASTKG PSVFPLAPSS KS                                           142
X81-B01 is the germlined IgG produced in HEK 293T cells version
of the X63-G06 Fab, as indicated above.
X101-A01 (aka DX-2922) is the germlined IgG produced in CHO cells
version of the X63-G06 Fab
```

Example 4

Affinity Maturation

In addition to optimizing the sequence of the clipped antibody (M142-H08), we also performed affinity maturation on two of the antibodies identified by phage display (M162-A04 and M160-G12). Both of these antibodies inhibit human pKal with single digit nanomolar potency, appear specific to pKal, and do not bind prekallikrein (Table 3). We first performed a novel form of light chain shuffling called ROLIC (Rapid Optimization of Light Chains) on M162-A04 and M160-G12 (see, e.g., WO 2009/102927 and U.S. 2009-0215119). From the screening of the antibodies discovered by ROLIC we identified one antibody with subnamolar potency (X63-G06) that shared the same heavy chain as M160-G12. We then constructed HV-CDR3 spiking affinity maturation libraries based on CDR3 sequences in M162-A04 and X63-G06 (described below).

Affinity Maturation by ROLIC.

We used ROLIC to affinity mature the two leads from Table 3 that were not cleaved (M162-A04 and M160-G12). This process identified one antibody that inhibits pKal with a subnanomolar $K_{i,app}$ (Table 7). X63-G06 inhibits pKal with a $K_{i,app}$ of approximately 0.4 nM as a Fab fragment. When this antibody was converted to an IgG that is germlined and sequenced optimized for CHO cell expression (X81-B01) it was found to inhibit pKal with a $K_{i,app}$ of approximately 0.2 nM.

Example 5

Affinity Maturation of Heavy Chain CDR1/2 and CDR3

We used two additional affinity maturation strategies to identify highly potent antibodies based on two different parental antibody inhibitor leads: M162-A04 and X63-G06. One approach was to generate libraries that shuffled the CDR1/2 of the HC of two different parental antibody inhibitor leads (M162-A04 and X63-G06) against additional CDR1/2 diversity. Another approach was to create heavy chain CDR3 spiking libraries based on these leads.

The 82 antibodies that were discovered based on improvements in M162-A04 due to modifications in either the CDR1/2 and CDR3 region are shown in Table 8. Inhibition screening with 10 nM antibody (as Fab fragments) revealed that there were 33 antibodies that inhibited pKal activity by over 90%. Several antibodies were shown to be subnanomolar inhibitors of human pKal.

The 62 antibodies that were discovered based on improvements in X63-G06 due to modifications in either the CDR1/2 and CDR3 region are shown in Table 9. Inhibition screening with 10 nM antibody (as Fab fragments) revealed that there were 24 antibodies that inhibited pKal activity by over 90%. Several antibodies were shown to be subnanomolar inhibitors of human pKal.

TABLE 8

Sequences of Antibodies Obtained from CDR1/2 and CDR3 Spiking Affinity Maturation Libraries Based on M162-A04 (SEQ OD NOs: 1124-1372)

| Antibody I.D. | % inhibition at 10 nM | human pKal Ki, app (nM) | LV-CDR1 (SEQ ID NO: 1124) | LV-CDR2 (SEQ ID NO: 1125) | LV-CDR3 (SEQ ID NO: 1126) | HV-CDR1 (SEQ ID NOs: 1127-1208) | HV-CDR2 (SEQ ID NOs: 1209-1290) | HV-CDR3 (SEQ ID NOs: 1291-1372) |
|---|---|---|---|---|---|---|---|---|
| M202-A12 | 97.5 | 0.2 | RASQSISSWLA | KASTLES | QQYNTYWT | HYIMM | GIYSSGGITVYADSVKG | QRTGVPRRDSFNI |
| M196-C06 | 97.2 | 0.1 | RASQSISSWLA | KASTLES | QQYNTYWT | IYSMH | SIYPSRGMTWYADSVKG | RRTGIPRRDAFDI |
| M198-F09 | 96.9 | 0.2 | RASQSISSWLA | KASTLES | QQYNTYWT | VYNMH | SIYPSGGMTYYADSVKG | RRTGIPRRDAFDI |
| M199-A08 | 96.4 | 0.06 | RASQSISSWLA | KASTLES | QQYNTYWT | HYIMM | GIYSSGGITVYADSVKG | RRIGVPRRDEFDI |
| M202-C01 | 96.3 | 0.1 | RASQSISSWLA | KASTLES | QQYNTYWT | HYIMM | GIYSSGGITVYADSVKG | RRTGVPRWDDFDI |

TABLE 8-continued

Sequences of Antibodies Obtained from CDR1/2 and CDR3 Spiking Affinity Maturation Libraries Based on M162-A04 (SEQ OD NOs: 1124-1372)

| Antibody I.D. | % inhibition at 10 nM | human pKal Ki, app (nM) | LV-CDR1 (SEQ ID NO: 1124) | LV-CDR2 (SEQ ID NO: 1125) | LV-CDR3 (SEQ ID NO: 1126) | HV-CDR1 (SEQ ID NOs: 1127-1208) | HV-CDR2 (SEQ ID NOs: 1209-1290) | HV-CDR3 (SEQ ID NOs: 1291-1372) |
|---|---|---|---|---|---|---|---|---|
| M198-A06 | 96.1 | 0.4 | RASQSISSWLA | KASTLES | QQYNTYWT | IYSMH | SIYSSGGPTKYADSVKG | RRTGIPRRDAFDI |
| M200-D03 | 95.9 | 0.1 | RASQSISSWLA | KASTLES | QQYNTYWT | HYIMM | GIYSSGGITVYADSVKG | RRIGVPRRDSFDM |
| M202-H03 | 95.7 | 0.1 | RASQSISSWLA | KASTLES | QQYNTYWT | HYIMM | GIYSSGGITVYADSVKG | RRTGVPRWDDFDI |
| M201-A07 | 95.7 | 0.1 | RASQSISSWLA | KASTLES | QQYNTYWT | HYIMM | GIYSSGGITVYADSVKG | RRTGVPRRDEFDI |
| M197-A01 | 95.3 | | RASQSISSWLA | KASTLES | QQYNTYWT | IYDMI | SIYPSGGNTSYADSVKG | RRTGIPRRDAFDI |
| M202-D09 | 95.0 | 0.4 | RASQSISSWLA | KASTLES | QQYNTYWT | HYIMM | GIYSSGGITVYADSVKG | RRIGVPRRDSFDI |
| M197-A09 | 94.9 | 0.6 | RASQSISSWLA | KASTLES | QQYNTYWT | VYNMH | SIYPSGGMTTYADSVKG | RRTGIPRRDAFDI |
| M198-G07 | 94.9 | | RASQSISSWLA | KASTLES | QQYNTYWT | IYDMT | SIYPSGGQTIYADSVKG | RRTGIPRRDAFDI |
| M200-A10 | 94.3 | 0.3 | RASQSISSWLA | KASTLES | QQYNTYWT | HYIMM | GIYSSGGITVYADSVKG | RRTGVPRRDSFDI |
| M197-H10 | 94.1 | | RASQSISSWLA | KASTLES | QQYNTYWT | SYNMH | SIVPSGGKTNYADSVKG | RRTGIPRRDAFDI |
| M196-D12 | 94.1 | 0.2 | RASQSISSWLA | KASTLES | QQYNTYWT | RYSMR | VIYPSGGQTYYADSVKG | RRTGIPRRDAFDI |
| M197-A08 | 93.7 | | RASQSISSWLA | KASTLES | QQYNTYWT | IYSMQ | SIGSSGGKTLYADSVKG | RRTGIPRRDAFDI |
| M198-B09 | 93.5 | | RASQSISSWLA | KASTLES | QQYNTYWT | VYSMT | SIGSSGGSTTYADSVKG | RRTGIPRRDAFDI |
| M198-E09 | 93.1 | | RASQSISSWLA | KASTLES | QQYNTYWT | IYDMN | SIYPSGGRTRYADSVKG | RRTGIPRRDAFDI |
| M202-B03 | 93.1 | 0.3 | RASQSISSWLA | KASTLES | QQYNTYWT | HYIMM | GIYSSGGITVYADSVKG | RRTGVPRRDDFDI |
| M198-C10 | 93.0 | | RASQSISSWLA | KASTLES | QQYNTYWT | HYMGMN | SIVPSGGWTQYADSVKG | RRTGIPRRDAFDI |
| M197-E12 | 93.0 | | RASQSISSWLA | KASTLES | QQYNTYWT | TYTMR | SIYPSGGKTQYADSVKG | RRTGIPRRDAFDI |
| M198-F04 | 92.9 | | RASQSISSWLA | KASTLES | QQYNTYWT | IYDMW | SIRPSGGITKYADSVKG | RRTGIPRRDAFDI |
| M197-H11 | 92.9 | | RASQSISSWLA | KASTLES | QQYNTYWT | IYNMI | SIYPSGGWTTYADSVKG | RRTGIPRRDAFDI |
| M197-F01 | 92.6 | | RASQSISSWLA | KASTLES | QQYNTYWT | IYHMY | SIGPSGGPTGYADSVKG | RRTGIPRRDAFDI |
| M198-E11 | 92.5 | | RASQSISSWLA | KASTLES | QQYNTYWT | TYSMY | SIYPSGGLTWYADSVKG | RRTGIPRRDAFDI |
| M202-C09 | 92.3 | 0.3 | RASQSISSWLA | KASTLES | QQYNTYWT | HYIMM | GIYSSGGITVYADSVKG | RRIGVPRRDDFDI |
| M198-H08 | 92.3 | | RASQSISSWLA | KASTLES | QQYNTYWT | IYDMY | SIGPSGGPTAYADSVKG | RRTGIPRRDAFDI |
| M198-F08 | 91.8 | | RASQSISSWLA | KASTLES | QQYNTYWT | VYSMW | SISSSGGMTEYADSVKG | RRTGIPRRDAFDI |
| M202-E06 | 91.5 | | RASQSISSWLA | KASTLES | QQYNTYWT | HYIMM | GIYSSGGITVYADSVKG | RRRGVPRRDDFDI |

TABLE 8-continued

Sequences of Antibodies Obtained from CDR1/2 and CDR3 Spiking Affinity Maturation Libraries Based on M162-A04 (SEQ OD NOs: 1124-1372)

| Antibody I.D. | % inhibition at 10 nM | human pKal Ki, app (nM) | LV-CDR1 (SEQ ID NO: 1124) | LV-CDR2 (SEQ ID NO: 1125) | LV-CDR3 (SEQ ID NO: 1126) | HV-CDR1 (SEQ ID NOs: 1127-1208) | HV-CDR2 (SEQ ID NOs: 1209-1290) | HV-CDR3 (SEQ ID NOs: 1291-1372) |
|---|---|---|---|---|---|---|---|---|
| M195-D12 | 90.8 | | RASQSISSWLA | KASTLES | QQYNTYWT | IYGMF | GIGPSGGPTKYADSVKG | RRTGIPRRDAFDI |
| M197-F03 | 90.7 | | RASQSISSWLA | KASTLES | QQYNTYWT | IYSMF | SIGPSGGVTHYADSVKG | RRTGIPRRDAFDI |
| M198-E02 | 90.3 | | RASQSISSWLA | KASTLES | QQYNTYWT | IYSMY | YIRPSGGNTKYADSVKG | RRTGIPRRDAFDI |
| M198-A02 | 89.1 | | RASQSISSWLA | KASTLES | QQYNTYWT | RYSMI | SIWSSGGATEYADSVKG | RRTGIPRRDAFDI |
| M202-A01 | 88.9 | | RASQSISSWLA | KASTLES | QQYNTYWT | HYIMM | GIYSSGGITVYADSVKG | RRIGVPRRDAFDI |
| M202-G03 | 88.3 | | RASQSISSWLA | KASTLES | QQYNTYWT | HYIMM | GIYSSGGITVYADSVKG | RRTGVPRRDSFEI |
| M195-B12 | 87.7 | | RASQSISSWLA | KASTLES | QQYNTYWT | KYWMY | YIRPSGGQTYYADSVKG | RRTGIPRRDAFDI |
| M198-A07 | 86.1 | | RASQSISSWLA | KASTLES | QQYNTYWT | RYQMH | WISPSGGITGYADSVKG | RRTGIPRRDAFDI |
| M198-H02 | 85.8 | | RASQSISSWLA | KASTLES | QQYNTYWT | PYNMY | WIVPGGVTKYADSVKG | RRTGIPRRDAFDI |
| M200-H07 | 85.4 | | RASQSISSWLA | KASTLES | QQYNTYWT | HYIMM | GIYSSGGITVYADSVKG | RRTGVPRRNAFDN |
| M201-H06 | 84.6 | | RASQSISSWLA | KASTLES | QQYNTYWT | HYIMM | GIYSSGGITVYADSVKG | RRTGVPRRDAFDI |
| M202-F06 | 84.2 | | RASQSISSWLA | KASTLES | QQYNTYWT | HYIMM | GIYSSGGITVYADSVKG | RRTGVPRWDAFDI |
| M195-C12 | 84.2 | | RASQSISSWLA | KASTLES | QQYNTYWT | MYQMF | SISPGGGTQYADSVKG | RRTGIPRRDAFDI |
| M202-H05 | 84.0 | | RASQSISSWLA | KASTLES | QQYNTYWT | HYIMM | GIYSSGGITVYADSVKG | RRTGVPRRDVFDI |
| M198-C05 | 83.9 | | RASQSISSWLA | KASTLES | QQYNTYWT | RYKMY | VIGPSGGATFYADSVKG | RRTGIPRRDAFDI |
| M196-H03 | 83.9 | | RASQSISSWLA | KASTLES | QQYNTYWT | RYVMW | SISPSGDTHYADSVKG | RRTGIPRRDAFDI |
| M200-E11 | 83.2 | | RASQSISSWLA | KASTLES | QQYNTYWT | HYIMM | GIYSSGGITVYADSVKG | RRTGVPRRDAFDN |
| M202-B04 | 81.9 | | RASQSISSWLA | KASTLES | QQYNTYWT | HYIMM | GIYSSGGITVYADSVKG | RRSGVPRRDDFDI |
| M202-A04 | 81.2 | | RASQSISSWLA | KASTLES | QQYNTYWT | HYIMM | GIYSSGGITVYADSVKG | RRKGIPRRDDFDI |
| M198-B12 | 80.7 | | RASQSISSWLA | KASTLES | QQYNTYWT | KYSMA | GIYPSGGRTLYADSVKG | RRTGIPRRDAFDI |
| M198-A09 | 77.3 | | RASQSISSWLA | KASTLES | QQYNTYWT | IYFMS | SIRSSGGPTWYADSVKG | RRTGIPRRDAFDI |
| M198-C06 | 76.5 | | RASQSISSWLA | KASTLES | QQYNTYWT | QYFMH | YIYPSGGMTEYADSVKG | RRTGIPRRDAFDI |
| M198-C09 | 75.4 | | RASQSISSWLA | KASTLES | QQYNTYWT | IYTMY | SISPSGGWTYYADSVKG | RRTGIPRRDAFDI |
| M195-B02 | 75.1 | | RASQSISSWLA | KASTLES | QQYNTYWT | PYLMW | YIGPSGGPTHYADSVKG | RRTGIPRRDAFDI |
| M198-F12 | 74.6 | | RASQSISSWLA | KASTLES | QQYNTYWT | IYTMM | SIWSGGQTKYADSVKG | RRTGIPRRDAFDI |
| M201-H08 | 74.5 | | RASQSISSWLA | KASTLES | QQYNTYWT | HYIMM | GIYSSGGITVYADSVKG | RRTGVPRRDALDN |

TABLE 8-continued

Sequences of Antibodies Obtained from CDR1/2 and CDR3 Spiking Affinity Maturation Libraries Based on M162-A04 (SEQ OD NOs: 1124-1372)

| Antibody I.D. | % inhibition at 10 nM | human pKal Ki, app (nM) | LV-CDR1 (SEQ ID NO: 1124) | LV-CDR2 (SEQ ID NO: 1125) | LV-CDR3 (SEQ ID NO: 1126) | HV-CDR1 (SEQ ID NOs: 1127-1208) | HV-CDR2 (SEQ ID NOs: 1209-1290) | HV-CDR3 (SEQ ID NOs: 1291-1372) |
|---|---|---|---|---|---|---|---|---|
| M202-C02 | 74.3 | | RASQSISSWLA | KASTLES | QQYNTYWT | HYIMM | GIYSSGGITVYADSVKG | RRPGVPRRDAFDI |
| M198-C03 | 72.4 | | RASQSISSWLA | KASTLES | QQYNTYWT | RYSMS | GISPSGGETSYADSVKG | RRTGIPRRDAFDI |
| M198-A08 | 72.3 | | RASQSISSWLA | KASTLES | QQYNTYWT | WYMMQ | RISPSGGTTYADSVKG | RRTGIPRRDAFDI |
| M195-A02 | 71.3 | | RASQSISSWLA | KASTLES | QQYNTYWT | QYMMM | GISSSGGHTDYADSVKG | RRTGIPRRDAFDI |
| M197-G10 | 67.6 | | RASQSISSWLA | KASTLES | QQYNTYWT | VYAMR | SIYPSGGKTWYADSVKG | RRTGIPRRDAFDI |
| M195-G02 | 67.5 | | RASQSISSWLA | KASTLES | QQYNTYWT | PYNMM | SIWPSGGTTDYADSVKG | RRTGIPRRDAFDI |
| M196-D02 | 66.2 | | RASQSISSWLA | KASTLES | QQYNTYWT | VYSMH | VIGPSGGITLYADSVKG | RRTGIPRRDAFDI |
| M199-A11 | 65.4 | | RASQSISSWLA | KASTLES | QQYNTYWT | HYIMM | GIYSSGGITVYADSVKG | RRRGIPRRDAFDI |
| M200-F01 | 65.1 | | RASQSISSWLA | KASTLES | QQYNTYWT | HYIMM | GIYSSGGITVYADSVKG | RRMGIPRRNAFDI |
| M198-D12 | 63.5 | 0.7 | RASQSISSWLA | KASTLES | QQYNTYWT | LYVMY | YIVPSGGPTAYADSVKG | RRTGIPRRDAFDI |
| M197-C12 | 56.4 | | RASQSISSWLA | KASTLES | QQYNTYWT | PYDML | YIVSSGGLTKYADSVKG | RRTGIPRRDAFDI |
| M198-G03 | 53.8 | | RASQSISSWLA | KASTLES | QQYNTYWT | QYTMV | WIYSSRANYADSVKG | RRTGIPRRDAFDI |
| M199-B01 | 53.4 | | RASQSISSWLA | KASTLES | QQYNTYWT | HYIMM | GIYSSGGITVYADSVKG | RRTGIPRRDAFDN |
| M202-A08 | 52.9 | | RASQSISSWLA | KASTLES | QQYNTYWT | HYIMM | GIYSSGGITVYADSVKG | RRTGIPRWDAFDI |
| M195-A12 | 51.7 | | RASQSISSWLA | KASTLES | QQYNTYWT | PYMMM | GIYPSGGYTVYADSVKG | RRTGIPRRDAFDI |
| M202-E03 | 51.4 | | RASQSISSWLA | KASTLES | QQYNTYWT | HYIMM | GIYSSGGITVYADSVKG | RRTGIPRRDAFEI |
| M196-G12 | 51.1 | | RASQSISSWLA | KASTLES | QQYNTYWT | NYSMD | RIYSSGGGTIYADSVKG | RRTGIPRRDAFDI |
| M195-F12 | 45.5 | | RASQSISSWLA | KASTLES | QQYNTYWT | HYVMM | YIVPSGGVTAYADSVKG | RRTGIPRRDAFDI |
| M200-B01 | 42.6 | | RASQSISSWLA | KASTLES | QQYNTYWT | HYIMM | GIYSSGGITVYADSVKG | RRTGIPRRDAFDS |
| M198-H09 | 41.1 | | RASQSISSWLA | KASTLES | QQYNTYWT | IYLMI | YIGPSGGPTEYADSVKG | RRTGIPRRDAFDI |
| M195-E12 | 38.0 | | RASQSISSWLA | KASTLES | QQYNTYWT | YYIMF | YISPSGGYTHYADSVKG | RRTGIPRRDAFDI |
| M201-A06 | 36.8 | | RASQSISSWLA | KASTLES | QQYNTYWT | HYIMM | GIYSSGGITVYADSVKG | RRTGIPRRDVFDI |
| M202-A10 | 36.3 | | RASQSISSWLA | KASTLES | QQYNTYWT | HYIMM | GIYSSGGITVYADSVKG | RRTGIPRRDSFDI |
| M197-G11 | 19.2 | | RASQSISSWLA | KASTLES | QQYNTYWT | TYAMV | SIYPSGGITTYADSVKG | RRTGIPRRDAFDI |
| M201-F11 | 15.7 | | RASQSISSWLA | KASTLES | QQYNTYWT | HYIMM | GIYSSGGITVYADSVKG | RRSGIPRRDAFDI |
| M198-A01 | 13.8 | | RASQSISSWLA | KASTLES | QQYNTYWT | PYTMI | SISSSGGMTPYADSVKG | RRTGIPRRDAFDI |

Amino Acid Sequences of Light Chain (LC) and Heavy Chain (HC) Variable Domain of pKal Antibodies Obtained from CDR1/2 and CDR3 Spiking Affinity Maturation Libraries Based on M162-A04 (SEQ ID NOs:1373-1536).

```
M195-A02                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-A02                HC
EVQLLESGGG LVQPGGSLRL SCAASGFTFS QYMMMWVRQA PGKGLEWVSG ISSSGGHTDY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M195-A12                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-A12                HC
EVQLLESGGG LVQPGGSLRL SCAASGFTFS PYMMMWVRQA PGKGLEWVSG IYPSGGYTVY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M195-B02                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-B02                HC
EVQLLESGGG LVQPGGSLRL SCAASGFTFS PYLMWVRQA PGKGLEWVSY IGPSGGPTHY     60

ADSVKGRFTI SRDNSKNTLY LQMNSLRAED TAVYYCAYRR TGIPRRDAFD IWGQGTMVTV   120

SSASTKGPSV FPLAPSSKS                                               139

M195-B12                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-B12                HC
EVQLLESGGG LVQPGGSLRL SCAASGFTFS KYWMYWVRQA PGKGLEWVSY IRPSGGQTYY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M195-C12                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-C12                HC
EVQLLESGGG LVQPGGSLRL SCAASGFTFS MYQMFWVRQA PGKGLEWVSS ISPGGGTQYA    60

DSVKGRFTIS RDNSKNTLYL QMNSLRAEDT AVYYCAYRRT GIPRRDAFDI WGQGTMVTVS   120

SASTKGPSVF PLAPSSKS                                                138

M195-D12                LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-D12                HC
EVQLLESGGG LVQPGGSLRL SCAASGFTFS IYGMFWVRQA PGKGLEWVSG IGPSGGPTKY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M195-E12                LC
QDIQMTQSPS TLSASVGDRV TITCRASQSI SSWLAWYQQK PGKAPNLLIY KASTLESGVP    60
```

-continued

```
M195-E12              HC
EVQLLESGGG LVQPGGSLRL SCAASGFTFS YYIMFWVRQA PGKGLEWVSY ISPSGGYTHY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M195-F12              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-F12              HC
EVQLLESGGG LVQPGGSLRL SCAASGFTFS HYVMMWVRQA PGKGLEWVSY IVPSGGVTAY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M0195-G02             LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M195-G02              HC
EVQLLESGGG LVQPGGSLRL SCAASGFTFS PYNMMWVRQA PGKGLEWVSS IWPSGGTTDY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M196-C06              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M196-C06              HC
EVQLLESGGG LVQPGGSLRL SCAASGFTFS IYSMHWVRQA PGKGLEWVSS IYPSRGMTWY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M196-D02              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M196-D02              HC
EVQLLESGGG LVQPGGSLRL SCAASGFTFS VYSMHWVRQA PGKGLEWVSV IGPSGGITLY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M196-D12              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M196-D12              HC
EVQLLESGGG LVQPGGSLRL SCAASGFTFS RYSMRWVRQA PGKGLEWVSV IYPSGGQTYY    60

ADSVKGRFTI SRDNSKNTLY LQMNSLRAED TAVYYCAYRR TGIPRRDAFD IWGQGTMVTV   120

SSASTKGPSV FPLAPSSKS                                                139

M196-G12              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M196-G12              HC
EVQLLESGGG LVQPGGSLRL SCAASGFTFS NYSMDWVRQA PGKGLEWVSR IYSSGGGTIY    60

ADSVKGRFTI SRDNSKNTLY LQMNSLRAED TAVYYCAYRR TGIPRRDAFD IWGQGTMVTV   120

SSASTKGPSV FPLAPSSKS                                                139
```

-continued

```
M196-H03              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M196-H03              HC
EVQLLESGGG LVQPGGSLRL SCAASGFTFS RYVMWWVRQA PGKGLEWVSS ISPSGDTHYA    60

DSVKGRFTIS RDNSKNTLYL QMNSLRAEDT AVYYCAYRRT GIPRRDAFDI WGQGTMVTVS   120

SASTKGPSVF PLAPSSKS                                                138

M197-A01              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-A01              HC
EVQLLESGGG LVQPGGSLRL SCAASGFTFS IYDMIWVRQA PGKGLEWVSS IYPSGGNTSY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M197-A08              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-A08              HC
EVQLLESGGG LVQPGGSLRL SCAASGFTFS IYSMQWVRQA PGKGLEWVSS IGSSGGKTLY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M197-A09              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-A09              HC
EVQLLESGGG LVQPGGSLRL SCAASGFTFS VYNMHWVRQA PGKGLEWVSS IYPSGGMTTY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M197-C12              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-C12              HC
EVQLLESGGG LVQPGGSLRL SCAASGFTFS PYDMLWVRQA PGKGLEWVSY IVSSGGLTKY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M197-E12              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-E12              HC
EVQLLESGGG LVQPGGSLRL SCAASGFTFS TYTMRWVRQA PGKGLEWVSS IYPSGGKTQY    60

ADSVKGRFTI SRDNSKNTLY LQMNSLRAED TAVYYCAYRR TGIPRRDAFD IWGQGTMVTV   120

SSASTKGPSV FPLAPSSKS                                               139

M197-F01              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M197-F01              HC
EVQLLESGGG LVQPGGSLRL SCAASGFTFS IYHMYWVRQA PGKGLEWVSS IGPSGGPTGY    60

ADSVKGRFTI SRDNSKNTLY LQMNSLRAED TAVYYCAYRR TGIPRRDAFD IWGQGTMVTV   120
```

```
SSASTKGPSV FPLAPSSKS                                            139

M197-F03                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M197-F03                 HC
EVQLLESGGG LVQPGGSLRL SCAASGFTFS IYSMFWVRQA PGKGLEWVSS IGPSGGVTHY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M197-G10                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M197-G10                 HC
EVQLLESGGG LVQPGGSLRL SCAASGFTFS VYAMRWVRQA PGKGLEWVSS IYPSGGKTWY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M197-G11                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M197-G11                 HC
EVQLLESGGG LVQPGGSLRL SCAASGFTFS TYAMVWVRQA PGKGLEWVSS IYPSGGITTY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M197-H10                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M197-H10                 HC
EVQLLESGGG LVQPGGSLRL SCAASGFTFS SYNMHWVRQA PGKGLEWVSS IVPSGGKTNY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M197-H11                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M197-H11                 HC
EVQLLESGGG LVQPGGSLRL SCAASGFTFS IYNMIWVRQA PGKGLEWVSS IYPSGGWTTY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M198-A01                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M198-A01                 HC
EVQLLESGGG LVQPGGSLRL SCAASGFTFS PYTMIWVRQA PGKGLEWVSS ISSSGGMTPY  60

ADSVKGRFTI SRDNSKNTLY LQMNSLRAED TAVYYCAYRR TGIPRRDAFD IWGQGTMVTV 120

SSASTKGPSV FPLAPSSKS                                            139

M198-A02                 LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK             107

M198-A02                 HC
```

-continued

```
EVQLLESGGG LVQPGGSLRL SCAASGFTFS RYSMIWVRQA PGKGLEWVSS IWSSGGATEY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-A06              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-A06              HC
EVQLLESGGG LVQPGGSLRL SCAASGFTFS IYSMHWVRQA PGKGLEWVSS IYSGGGPTKY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-A07              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-A07              HC
EVQLLESGGG LVQPGGSLRL SCAASGFTFS RYQMHWVRQA PGKGLEWVSW ISPSGGITGY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-A08              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-A08              HC
EVQLLESGGG LVQPGGSLRL SCAASGFTFS WYMMQWVRQA PGKGLEWVSR ISPSGGTTYA   60

DSVKGRFTIS RDNSKNTLYL QMNSLRAEDT AVYYCAYRRT GIPRRDAFDI WGQGTMVTVS  120

SASTKGPSVF PLAPSSKS                                               138

M198-A09              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-A09              HC
EVQLLESGGG LVQPGGSLRL SCAASGFTFS IYFMSWVRQA PGKGLEWVSS IRSGGPTWY    60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-B09              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-B09              HC
EVQLLESGGG LVQPGGSLRL SCAASGFTFS VYSMTWVRQA PGKGLEWVSS IGSSGGSTTY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-B12              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-B12              HC
EVQLLESGGG LVQPGGSLRL SCAASGFTFS KYSMAWVRQA PGKGLEWVSG IYPSGGRTLY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-C03              LC
QDIQMTQSPS TLSASVGDRV TITCRASQSI SSWLAWYQQK PGKAPNLLIY KASTLESGVP   60
```

-continued

```
SRFSGSGSGT EFTLTISSLQ PDDFATYYCQ QYNTYWTFGQ GTKVEIK                  107

M198-C03               HC
EVQLLESGGG LVQPGGSLRL SCAASGFTFS RYSMSWVRQA PGKGLEWVSG ISPSGGETSY    60

ADSVKGRFTI SRDNSKNTLY LQMNSLRAED TAVYYCAYRR TGIPRRDAFD IWGQGTMVTV    120

SSASTKGPSV FPLAPSSKS                                                 139

M198-C05               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-C05               HC
EVQLLESGGG LVQPGGSLRL SCAASGFTFS RYKMYWVRQA PGKGLEWVSV IGPSGGATFY    60

ADSVKGRFTI SRDNSKNTLY LQMNSLRAED TAVYYCAYRR TGIPRRDAFD IWGQGTMVTV    120

SSASTKGPSV FPLAPSSKS                                                 139

M198-C06               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-C06               HC
EVQLLESGGG LVQPGGSLRL SCAASGFTFS QYFMHWVRQA PGKGLEWVSY IYPSGGMTEY    60

ADSVKGRFTI SRDNSKNTLY LQMNSLRAED TAVYYCAYRR TGIPRRDAFD IWGQGTMVTV    120

SSASTKGPSV FPLAPSSKS                                                 139

M198-C09               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-C09               HC
EVQLLESGGG LVQPGGSLRL SCAASGFTFS IYTMYWVRQA PGKGLEWVSS ISPSGGWTYY    60

ADSVKGRFTI SRDNSKNTLY LQMNSLRAED TAVYYCAYRR TGIPRRDAFD IWGQGTMVTV    120

SSASTKGPSV FPLAPSSKS                                                 139

M198-C10               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-C10               HC
EVQLLESGGG LVQPGGSLRL SCAASGFTFS HYMGMNWVRQ APGKGLEWVS SIVPSGGWTQ    60

YADSVKGRFT ISRDNSKNTL YLQMNSLRAE DTAVYYCAYR RTGIPRRDAF DIWGQGTMVT    120

VSSASTKGPS VFPLAPSSKS                                                140

M198-D12               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-D12               HC
EVQLLESGGG LVQPGGSLRL SCAASGFTFS LYVMYWVRQA PGKGLEWVSY IVPSGGPTAY    60

ADSVKGRFTI SRDNSKNTLY LQMNSLRAED TAVYYCAYRR TGIPRRDAFD IWGQGTMVTV    120

SSASTKGPSV FPLAPSSKS                                                 139

M198-E02               LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                  107

M198-E02               HC
EVQLLESGGG LVQPGGSLRL SCAASGFTFS IYSMYWVRQA PGKGLEWVSY IRPSGGNTKY    60

ADSVKGRFTI SRDNSKNTLY LQMNSLRAED TAVYYCAYRR TGIPRRDAFD IWGQGTMVTV    120

SSASTKGPSV FPLAPSSKS                                                 139
```

```
M198-E09              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-E09              HC
EVQLLESGGG LVQPGGSLRL SCAASGFTFS IYDMNWVRQA PGKGLEWVSS IYPSGGRTRY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-E11              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-E11              HC
EVQLLESGGG LVQPGGSLRL SCAASGFTFS TYSMYWVRQA PGKGLEWVSS IYPSGGLTWY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-F04              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-F04              HC
EVQLLESGGG LVQPGGSLRL SCAASGFTFS IYDMWWVRQA PGKGLEWVSS IRPSGGITKY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-F08              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-F08              HC
EVQLLESGGG LVQPGGSLRL SCAASGFTFS VYSMWWVRQA PGKGLEWVSS ISSSGGMTEY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-F09              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-F09              HC
EVQLLESGGG LVQPGGSLRL SCAASGFTFS VYNMHWVRQA PGKGLEWVSS IYPSGGMTYY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-F12              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-F12              HC
EVQLLESGGG LVQPGGSLRL SCAASGFTFS IYTMWWVRQA PGKGLEWVSS IWSSGGQTKY   60

ADSVKGRFTI SRDNSKNTLY LQMNSLRAED TAVYYCAYRR TGIPRRDAFD IWGQGTMVTV  120

SSASTKGPSV FPLAPSSKS                                              139

M198-G03              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M198-G03              HC
EVQLLESGGG LVQPGGSLRL SCAASGFTFS QYTMVWVRQA PGKGLEWVSW IYSSRANYAD   60

SVKGRFTISR DNSKNTLYLQ MNSLRAEDTA VYYCAYRRTG IPRRDAFDIW GQGTMVTVSS  120
```

```
ASTKGPSVFP LAPSSKS                                                     137

M198-G07                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M198-G07                HC
EVQLLESGGG LVQPGGSLRL SCAASGFTFS IYDMTWVRQA PGKGLEWVSS IYPSGGQTIY       60

ADSVKGRFTI SRDNSKNTLY LQMNSLRAED TAVYYCAYRR TGIPRRDAFD IWGQGTMVTV      120

SSASTKGPSV FPLAPSSKS                                                   139

M198-H02                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M198-H02                HC
EVQLLESGGG LVQPGGSLRL SCAASGFTFS PYNMYWVRQA PGKGLEWVSW IVPGGVTKYA       60

DSVKGRFTIS RDNSKNTLYL QMNSLRAEDT AVYYCAYRRT GIPRRDAFDI WGQGTMVTVS      120

SASTKGPSVF PLAPSSKS                                                    138

M198-H08                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M198-H08                HC
EVQLLESGGG LVQPGGSLRL SCAASGFTFS IYDMYWVRQA PGKGLEWVSS IGPSGGPTAY       60

ADSVKGRFTI SRDNSKNTLY LQMNSLRAED TAVYYCAYRR TGIPRRDAFD IWGQGTMVTV      120

SSASTKGPSV FPLAPSSKS                                                   139

M198-H09                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M198-H09                HC
EVQLLESGGG LVQPGGSLRL SCAASGFTFS IYLMIWVRQA PGKGLEWVSY IGPSGGPTEY       60

ADSVKGRFTI SRDNSKNTLY LQMNSLRAED TAVYYCAYRR TGIPRRDAFD IWGQGTMVTV      120

SSASTKGPSV FPLAPSSKS                                                   139

M199-A08                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M199-A08                HC
EVQLLESGGG LVQPGGSLRL SCAASGFTFS HYIMMWVRQA PGKGLEWVSG IYSSGGITVY       60

ADSVKGRFTI SRDNSKNTLY LQMNSLRAED TAVYYCAYRR IGVPRRDEFD IWGQGTMVTV      120

SSASTKGPSV FPLAPSSKS                                                   139

M199-A11                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M199-A11                HC
EVQLLESGGG LVQPGGSLRL SCAASGFTFS HYIMMWVRQA PGKGLEWVSG IYSSGGITVY       60

ADSVKGRFTI SRDNSKNTLY LQMNSLRAED TAVYYCAYRR RGIPRRDAFD IWGQGTMVTV      120

SSASTKGPSV FPLAPSSKS                                                   139

M199-B01                LC
QDIQMTQSPS TLSASVGDRV TITCRASQSI SSWLAWYQQK PGKAPNLLIY KASTLESGVP       60

SRFSGSGSGT EFTLTISSLQ PDDFATYYCQ QYNTYWTFGQ GTKVEIK                    107

M199-B01                HC
```

-continued

```
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAFRR TGIPRRDAFD NWGQGTMVTV     120

SSASTKGPSV FPLAPSSKS                                                  139

M200-A10              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-A10              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR TGVPRRDSFD IWGQGTMVTV     120

SSASTKGPSV FPLAPSSKS                                                  139

M200-B01              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-B01              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR TGIPRRDAFD SWGQGTMVTV     120

SSASTKGPSV FPLAPSSKS                                                  139

M200-D03              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-D03              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAWRR IGVPRRDSFD MWGQGTMVTV     120

SSASTKGPSV FPLAPSSKS                                                  139

M200-E11              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-E11              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR TGVPRRDAFD NWGQGTMVTV     120

SSASTKGPSV FPLAPSSKS                                                  139

M200-F01              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-F01              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR MGIPRRNAFD IWGQGTMVTV     120

SSASTKGPSV FPLAPSSKS                                                  139

M200-H07              LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                   107

M200-H07              HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR TGVPRRNAFD NWGQGTMVTV     120

SSASTKGPSV FPLAPSSKS                                                  139

M201-A06              LC
QDIQMTQSPS TLSASVGDRV TITCRASQSI SSWLAWYQQK PGKAPNLLIY KASTLESGVP      60
```

```
SRFSGSGSGT EFTLTISSLQ PDDFATYYCQ QYNTYWTFGQ GTKVEIK               107

M201-A06              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR TGIPRRDVFD IWGQGTMVTV 120

SSASTKGPSV FPLAPSSKS                                             139

M201-A07              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M201-A07              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR TGVPRRDEFD IWGQGTMVTV 120

SSASTKGPSV FPLAPSSKS                                             139

M201-F11              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M201-F11              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR SGIPRRDAFD IWGQGTMVTV 120

SSASTKGPSV FPLAPSSKS                                             139

M201-H06              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M201-H06              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR TGVPRRDAFD IWGQGTMVTV 120

SSASTKGPSV FPLAPSSKS                                             139

M201-H08              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M201-H08              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR TGVPRRDALD NWGQGTMVTV 120

SSASTKGPSV FPLAPSSKS                                             139

M202-A01              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M202-A01              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR IGVPRRDAFD IWGQGTMVTV 120

SSASTKGPSV FPLAPSSKS                                             139

M202-A04              LC
QDIQMTQSPS TLSASVGDRV TITCRASQSI SSWLAWYQQK PGKAPNLLIY KASTLESGVP  60

SRFSGSGSGT EFTLTISSLQ PDDFATYYCQ QYNTYWTFGQ GTKVEIK               107

M202-A04              HC
EVQLLESGGG LVQPGGSLRL SCAASGFTFS HYIMMWVRQA PGKGLEWVSG IYSSGGITVY  60

ADSVKGRFTI SRDNSKNTLY LQMNSLRAED TAVYYCAYRR KGIPRRDDFD IWGQGTMVTV 120

SSASTKGPSV FPLAPSSKS                                             139
```

-continued

```
M202-A08              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-A08              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR TGIPRWDAFD IWGQGTMVTV  120

SSASTKGPSV FPLAPSSKS                                              139

M202-A10              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-A10              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAFRR TGIPRRDSFD IWGQGTMVTV  120

SSASTKGPSV FPLAPSSKS                                              139

M202-A12              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-A12              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYQR TGVPRRDSFD IWGQGTMVTV  120

SSASTKGPSV FPLAPSSKS                                              139

M202-B03              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-B03              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR TGVPRRDDFD IWGQGTMVTV  120

SSASTKGPSV FPLAPSSKS                                              139

M202-B04              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-B04              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR SGVPRRDDFD IWGQGTMVTV  120

SSASTKGPSV FPLAPSSKS                                              139

M202-C01              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-C01              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR TGVPRWDDFD IWGQGTMVTV  120

SSASTKGPSV FPLAPSSKS                                              139

M202-C02              LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK                107

M202-C02              HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR PGVPRRDAFD IWGQGTMVTV  120
```

-continued

```
SSASTKGPSV FPLAPSSKS                                             139

M202-C09                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-C09                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR IGVPRRDDFD IWGQGTMVTV  120

SSASTKGPSV FPLAPSSKS                                             139

M202-D09                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-D09                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR IGVPRRDSFD IWGQGTMVTV  120

SSASTKGPSV FPLAPSSKS                                             139

M202-E03                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-E03                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR TGIPRRDAFE IWGQGTMVTV  120

SSASTKGPSV FPLAPSSKS                                             139

M202-E06                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-E06                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR RGVPRRDDFD IWGQGTMVTV  120

SSASTKGPSV FPLAPSSKS                                             139

M202-F06                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-F06                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAYRR TGVPRWDAFD IWGQGTMVTV  120

SSASTKGPSV FPLAPSSKS                                             139

M202-G03                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-G03                 HC
EVQLLESGGG LVQPGGSLRL SCAASGFTFS HYIMMWVRQA PGKGLEWVSG IYSSGGITVY   60

ADSVKGRFTI SRDNSKNTLY LQMNSLRAED TAVYYCAFRR TGVPRRDSFE IWGQGTMVTV  120

SSASTKGPSV FPLAPSSKS                                             139

M202-H03                 LC
QDIQMTQSPS TLSASVGDRV TITCRASQSI SSWLAWYQQK PGKAPNLLIY KASTLESGVP   60

SRFSGSGSGT EFTLTISSLQ PDDFATYYCQ QYNTYWTFGQ GTKVEIK               107

M202-H03                 HC
```

-continued

```
M202-H05                              
EVQLLESGGG LVQPGGSLRL SCAASGFTFS HYIMMWVRQA PGKGLEWVSG IYSSGGITVY    60

ADSVKGRFTI SRDNSKNTLY LQMNSLRAED TAVYYCAFRR TGVPRWDDFD IWGQGTMVTV   120

SSASTKGPSV FPLAPSSKS                                                139

M202-H05              LC
QDIQMTQSPS TLSASVGDRV TITCRASQSI SSWLAWYQQK PGKAPNLLIY KASTLESGVP    60

SRFSGSGSGT EFTLTISSLQ PDDFATYYCQ QYNTYWTFGQ GTKVEIK                 107

M202-H05              HC
EVQLLESGGG LVQPGGSLRL SCAASGFTFS HYIMMWVRQA PGKGLEWVSG IYSSGGITVY    60

ADSVKGRFTI SRDNSKNTLY LQMNSLRAED TAVYYCAFRR TGVPRRDVFD IWGQGTMVTV   120

SSASTKGPSV FPLAPSSKS                                                139
```

TABLE 9

Sequences of Antibodies Obtained from CDR1/2 and CDR3 Spiking Affinity Maturation Libraries Based on X63-G06 (SEQ ID NOs: 1537-1725)

| Antibody I.D. | % inhibition at 10 nM | human pKal Ki, app (nM) | LV-CDR1 (SEQ ID NO: 1537) | LV-CDR2 (SEQ ID NO: 1538) | LV-CDR3 (SEQ ID NO: 1539) | HV-CDR1 (SEQ ID NOs: 1540-1601) | HV-CDR2 (SEQ ID NOs: 1602-1663) | HV-CDR3 (SEQ ID NOs: 1664-1725) |
|---|---|---|---|---|---|---|---|---|
| M209-F04 | 97.6 | 0.09 | RTSQFVNS-NYLA | GASSRAT | QQSSRTPWT | HYLMT | YISPSGGHTIYADS-VKG | VARGIAARSRTSYLDq |
| M209-C11 | 96.2 | 0.14 | RTSQFVNS-NYLA | GASSRAT | QQSSRTPWT | HYLMT | YISPSGGHTIYADS-VKG | VGQGIRGRSRTSYFAq |
| M206-H08 | 96.0 | 0.17 | RTSQFVNS-NYLA | GASSRAT | QQSSRTPWT | DYMMA | SIVPSGGHTHYADS-VKG | VARGIAARSRTSYFDY |
| M210-C12 | 95.6 | 0.16 | RTSQFVNS-NYLA | GASSRAT | QQSSRTPWT | HYLMT | YISPSGGHTIYADS-VKG | VAQGIAARSRTSSVDq |
| M208-F04 | 95.4 | 0.2 | RTSQFVNS-NYLA | GASSRAT | QQSSRTPWT | HYLMT | YISPSGGHTIYADS-VKG | VARGIAARSRTSFFDY |
| M206-B10 | 94.7 | 0.3 | RTSQFVNS-NYLA | GASSRAT | QQSSRTPWT | qYLMA | SIYPSGGWTKYADS-VKG | VARGIAARSRTSYFDY |
| M208-H02 | 94.4 | 0.2 | RTSQFVNS-NYLA | GASSRAT | QQSSRTPWT | HYLMT | YISPSGGHTIYADS-VKG | VARGIASRSRTRYCDY |
| M210-G04 | 94.2 | 0.3 | RTSQFVNS-NYLA | GASSRAT | QQSSRTPWT | HYLMT | YISPSGGHTIYADS-VKG | VATGIVARSRTRYFDq |
| M210-H06 | 93.8 | 0.2 | RTSQFVNS-NYLA | GASSRAT | QQSSRTPWT | HYLMT | YISPSGGHTIYADS-VKG | VARGIAARSRTRYFDY |
| M208-E10 | 93.7 | 0.09 | RTSQFVNS-NYLA | GASSRAT | QQSSRTPWT | HYLMT | YISPSGGHTIYADS-VKG | VAQGISARSRTSYFDY |
| M209-B09 | 93.5 | 0.2 | RTSQFVNS-NYLA | GASSRAT | QQSSRTPWT | HYLMT | YISPSGGHTIYADS-VKG | VAQGIVARSRTSYLHq |
| M209-C12 | 93.4 | | RTSQFVNS-NYLA | GASSRAT | QQSSRTPWT | HYLMT | YISPSGGHTIYADS-VKG | VGRGIAARSRTSqLDY |
| M208-G03 | 93.4 | 0.3 | RTSQFVNS-NYLA | GASSRAT | QQSSRTPWT | HYLMT | YISPSGGHTIYADS-VKG | VARGIAARSRTSYLDY |
| M206-A06 | 93.0 | | RTSQFVNS-NYLA | GASSRAT | QQSSRTPWT | NYMMG | SISPSGGLTKYADS-VKG | VARGIAARSRTSYFDY |
| M210-H07 | 92.8 | 0.4 | RTSQFVNS-NYLA | GASSRAT | QQSSRTPWT | HYLMT | YISPSGGHTIYADS-VKG | VARGIAARSRTRYFDq |
| M206-F01 | 92.6 | 0.2 | RTSQFVNS-NYLA | GASSRAT | QQSSRTPWT | GYMMV | RISPSGGPTIYADS-VKG | VARGIAARSRTSYFDY |
| M208-F10 | 92.5 | 0.2 | RTSQFVNS-NYLA | GASSRAT | QQSSRTPWT | HYLMT | YISPSGGHTIYADS-VKG | VARGIAARSRTSYFDq |

TABLE 9-continued

Sequences of Antibodies Obtained from CDR1/2 and CDR3 Spiking Affinity Maturation Libraries Based on X63-G06 (SEQ ID NOs: 1537-1725)

| Antibody I.D. | % inhibition at 10 nM | human pKal Ki, app (nM) | LV-CDR1 (SEQ ID NO: 1537) | LV-CDR2 (SEQ ID NO: 1538) | LV-CDR3 (SEQ ID NO: 1539) | HV-CDR1 (SEQ ID NOs: 1540-1601) | HV-CDR2 (SEQ ID NOs: 1602-1663) | HV-CDR3 (SEQ ID NOs: 1664-1725) |
|---|---|---|---|---|---|---|---|---|
| M209-E02 | 92.4 | 0.3 | RTSQFVNS-NYLA | GASSRAT | QQSSRTPWT | HYLMT | YISPSGGHTIYADS-VKG | VARGIAARSRTILLDq |
| M208-C06 | 91.7 | 0.4 | RTSQFVNS-NYLA | GASSRAT | QQSSRTPWT | HYLMT | YISPSGGHTIYADS-VKG | VARGIAARSRTSFIDY |
| M205-D04 | 91.5 | 0.4 | RTSQFVNS-NYLA | GASSRAT | QQSSRTPWT | TYKMq | SISPSGGPTNYADS-VKG | VARGIAARSRTSYFDY |
| M210-G10 | 91.2 | 0.4 | RTSQFVNS-NYLA | GASSRAT | QQSSRTPWT | HYLMT | YISPSGGHTIYADS-VKG | VARGIAARSRTSYLDF |
| M207-A04 | 90.9 | | RTSQFVNS-NYLA | GASSRAT | QQSSRTPWT | HYLMT | YISPSGGHTIYADS-VKG | VARGIAARSRTRSFDY |
| M210-B02 | 90.9 | 0.2 | RTSQFVNS-NYLA | GASSRAT | QQSSRTPWT | HYLMT | YISPSGGHTIYADS-VKG | VARGIAARSRTSYFNq |
| M208-B01 | 90.1 | | RTSQFVNS-NYLA | GASSRAT | QQSSRTPWT | HYLMT | YISPSGGHTIYADS-VKG | VARGIAARSRTSFFDq |
| M209-G07 | 89.8 | | RTSQFVNS-NYLA | GASSRAT | QQSSRTPWT | HYLMT | YISPSGGHTIYADS-VKG | VARGIAARSRTSYFDT |
| M204-A02 | 89.5 | | RTSQFVNS-NYLA | GASSRAT | QQSSRTPWT | DYMMT | YISPSGGLTSYADS-VKG | VARGIAARSRTSYFDY |
| M206-H01 | 87.6 | | RTSQFVNS-NYLA | GASSRAT | QQSSRTPWT | EYMMV | RISPSGGTTEYADS-VKG | VARGIAARSRTSYFDY |
| M209-B11 | 87.3 | | RTSQFVNS-NYLA | GASSRAT | QQSSRTPWT | HYLMT | YISPSGGHTIYADS-VKG | VARGIAARSRTRYIDq |
| M206-F09 | 86.8 | | RTSQFVNS-NYLA | GASSRAT | QQSSRTPWT | VYMMS | SIVPSGGSTTYADS-VKG | VARGIAARSRTSYFDY |
| M209-C02 | 86.8 | | RTSQFVNS-NYLA | GASSRAT | QQSSRTPWT | HYLMT | YISPSGGHTIYADS-VKG | VARGIAYRRRTSYFDY |
| M208-G02 | 86.7 | | RTSQFVNS-NYLA | GASSRAT | QQSSRTPWT | HYLMT | YISPSGGHTIYADS-VKG | VARGIADRSRTSYSDY |
| M205-C11 | 86.5 | | RTSQFVNS-NYLA | GASSRAT | QQSSRTPWT | QYMMM | RISPSGGSTLYADS-VKG | VARGIAARSRTSYFDY |
| M205-H08 | 85.9 | | RTSQFVNS-NYLA | GASSRAT | QQSSRTPWT | DYMMM | SIVPSGGHTqYADS-VKG | VARGIAARSRTSYFDY |
| M210-H01 | 85.5 | | RTSQFVNS-NYLA | GASSRAT | QQSSRTPWT | HYLMT | YISPSGGHTIYADS-VKG | VARGIAARSRNSqQDY |
| M209-D12 | 85.4 | | RTSQFVNS-NYLA | GASSRAT | QQSSRTPWT | HYLMT | YISPSGGHTIYADS-VKG | VARGIAARSRTSYFDq |
| M209-H09 | 85.3 | | RTSQFVNS-NYLA | GASSRAT | QQSSRTPWT | HYLMT | YISPSGGHTIYADS-VKG | VARGIAARSRTVYFDH |
| M204-E12 | 84.1 | | RTSQFVNS-NYLA | GASSRAT | QQSSRTPWT | TYMMq | YIGPSGGKTDYADS-VKG | VARGIAARSRTSYFDY |
| M209-H03 | 82.6 | | RTSQFVNS-NYLA | GASSRAT | QQSSRTPWT | HYLMT | YISPSGGHTIYADS-VKG | VAQGIAARSRTTqFDY |
| M206-H05 | 82.5 | | RTSQFVNS-NYLA | GASSRAT | QQSSRTPWT | GYKMq | SISPSGGITMYADS-VKG | VARGIAARSRTSYFDY |
| M209-D03 | 80.4 | | RTSQFVNS-NYLA | GASSRAT | QQSSRTPWT | HYLMT | YISPSGGHTIYADS-VKG | VGRGIAARSRTSFFDq |
| M205-A02 | 80.3 | | RTSQFVNS-NYLA | GASSRAT | QQSSRTPWT | TYLMA | GIVSSGGRTLYADS-VKG | VARGIAARSRTSYFDY |

TABLE 9-continued

Sequences of Antibodies Obtained from CDR1/2 and CDR3 Spiking Affinity
Maturation Libraries Based on X63-G06 (SEQ ID NOs: 1537-1725)

| Antibody I.D. | % inhibition at 10 nM | human pKal Ki, app (nM) | LV-CDR1 (SEQ ID NO: 1537) | LV-CDR2 (SEQ ID NO: 1538) | LV-CDR3 (SEQ ID NO: 1539) | HV-CDR1 (SEQ ID NOs: 1540-1601) | HV-CDR2 (SEQ ID NOs: 1602-1663) | HV-CDR3 (SEQ ID NOs: 1664-1725) |
|---|---|---|---|---|---|---|---|---|
| M208-A10 | 78.5 | | RTSQFVNS-NYLA | GASSRAT | QQSSRTPWT | HYLMT | YISPSGGHTIYADS-VKG | VARGIAARSRTSqFDH |
| M205-E11 | 78.2 | | RTSQFVNS-NYLA | GASSRAT | QQSSRTPWT | NYTMG | SISPSGGKTDYADS-VKG | VARGIAARSRTSYFDY |
| M206-E02 | 77.6 | | RTSQFVNS-NYLA | GASSRAT | QQSSRTPWT | EYMMM | VISPSGGQTHYADS-VKG | VARGIAARSRTSYFDY |
| M205-H01 | 77.1 | | RTSQFVNS-NYLA | GASSRAT | QQSSRTPWT | NYTMQ | YISPSGGYTGYADS-VKG | VARGIAARSRTSYFDY |
| M207-A02 | 76.6 | | RTSQFVNS-NYLA | GASSRAT | QQSSRTPWT | HYLMT | YISPSGGHTIYADS-VKG | VARGIAARSRTINLDY |
| M209-H07 | 76.1 | | RTSQFVNS-NYLA | GASSRAT | QQSSRTPWT | HYLMT | YISPSGGHTIYADS-VKG | VARGIAARqRTSYYDY |
| M209-G01 | 74.8 | | RTSQFVNS-NYLA | GASSRAT | QQSSRTPWT | HYLMT | YISPSGGHTIYADS-VKG | VAqGISGRSRLSYVDY |
| M210-A06 | 74.8 | | RTSQFVNS-NYLA | GASSRAT | QQSSRTPWT | HYLMT | YISPSGGHTIYADS-VKG | VARGIAARSRTSqFDY |
| M209-D02 | 74.7 | | RTSQFVNS-NYLA | GASSRAT | QQSSRTPWT | HYLMT | YISPSGGHTIYADS-VKG | VARGITARSRTSYFDD |
| M205-B04 | 71.1 | | RTSQFVNS-NYLA | GASSRAT | QQSSRTPWT | NYDMI | SISSSGGTTKYADS-VKG | VARGIAARSRTSYFDY |
| M203-A03 | 69.1 | | RTSQFVNS-NYLA | GASSRAT | QQSSRTPWT | VYMMI | SISPSGGQTTYADS-VKG | VARGIAARSRTSYFDY |
| M209-E03 | 68.8 | | RTSQFVNS-NYLA | GASSRAT | QQSSRTPWT | HYLMT | YISPSGGHTIYADS-VKG | qARGIAARSRTSYFDY |
| M207-A01 | 67.2 | | RTSQFVNS-NYLA | GASSRAT | QQSSRTPWT | HYLMT | YISPSGGHTIYADS-VKG | VARGISARSRTSCFDY |
| M206-C03 | 65.5 | | RTSQFVNS-NYLA | GASSRAT | QQSSRTPWT | qYMMV | SIYSSGGNTPYADS-VKG | VARGIAARSRTSYFDY |
| M207-C05 | 61.4 | | RTSQFVNS-NYLA | GASSRAT | QQSSRTPWT | HYLMT | YISPSGGHTIYADS-VKG | VGRGIAARSRTSYFDK |
| M205-A12 | 58.8 | | RTSQFVNS-NYLA | GASSRAT | QQSSRTPWT | QYDMI | YISSSGGFTRYADS-VKG | VARGIAARSRTSYFDY |
| M205-F03 | 58.6 | | RTSQFVNS-NYLA | GASSRAT | QQSSRTPWT | SqQMV | YISPSGGNTYYADS-VKG | VARGIAARSRTSYFDY |
| M203-A01 | 51.4 | | RTSQFVNS-NYLA | GASSRAT | QQSSRTPWT | NYLMA | WIVPSGGYTEYADS-VKG | VARGIAARSRTSYFDY |
| M209-B01 | 47.0 | | RTSQFVNS-NYLA | GASSRAT | QQSSRTPWT | HYLMT | YISPSGGHTIYADS-VKG | VARGIVARSRTSNFDq |
| M208-D12 | 43.7 | | RTSQFVNS-NYLA | GASSRAT | QQSSRTPWT | HYLMT | YISPSGGHTIYADS-VKG | LARGIAARSRTSYqDI |
| M206-H04 | 19.0 | | RTSQFVNS-NYLA | GASSRAT | QQSSRTPWT | SYMMV | SISPSGGYTIqADS-VKG | VARGIAARSRTSYFDY |

Amino Acid Sequences of Light Chain (LC) and Heavy Chain (HC) Variable Domain of pKal Antibodies Obtained from CDR1/2 and CDR3 Spiking Affinity Maturation Libraries Based on X63-G06. (SEQ ID NOs:1726-1849)

```
M203-A01               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M203-A01               HC
EVQLLESGGG LVQPGGSLRL SCAASGFTFS NYLMAWVRQA PGKGLEWVSW IVPSGGYTEY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M203-A03               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M203-A03               HC
EVQLLESGGG LVQPGGSLRL SCAASGFTFS VYMMIWVRQA PGKGLEWVSS ISPSGGQTTY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M204-A02               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M204-A02               HC
EVQLLESGGG LVQPGGSLRL SCAASGFTFS DYMMTWVRQA PGKGLqWVSY ISPSGGLTSY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M204-E12               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M204-E12               HC
EVQLLESGGG LVQPGGSLRL SCAASGFTFS TYMMqWVRQA PGKGLEWVSY IGPSGGKTDY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M205-A02               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M205-A02               HC
EVQLLESGGG LVQPGGSLRL SCAASGFTFS TYLMAWVRQA PGKGLEWVSG IVSSGGRTLY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M205-A12               LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M205-A12               HC
EVQLLESGGG LVQPGGSLRL SCAASGFTFS QYDMIWVRQA PGKGLEWVSY ISSSGGFTRY   60

ADSVKGRFTI SRDNSKNTLY LQMNSLRAED TAVYYCARVA RGIAARSRTS YFDYWGQGTL  120

VTVSSASTKG PSVFPLAPSS KS                                           142

M205-B04               LC
QDIQMTQSPG TLSLSPGERA TLSCRTSQFV NSNYLAWYQQ TPGQAPRLLI YGASSRATGI   60
```

```
PDRFSGTGYG TDFTLTISRL EPEDYGTYYC QQSSRTPWTF GQGTRVEIK         109

M205-B04          HC
EVQLLESGGG LVQPGGSLRL SCAASGFTFS NYDMIWVRQA PGKGLEWVSS ISSSGGTTKY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-C11          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-C11          HC
EVQLLESGGG LVQPGGSLRL SCAASGFTFS QYMMMWVRQA PGKGLEWVSR ISPSGGSTLY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-D04          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-D04          HC
EVQLLESGGG LVQPGGSLRL SCAASGFTFS TYKMqWVRQA PGKGLEWVSS ISPSGGPTNY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-E11          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-E11          HC
EVQLLESGGG LVQPGGSLRL SCAASGFTFS NYTMGWVRQA PGKGLEWVSS ISPSGGKTDY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-F03          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-F03          HC
EVQLLESGGG LVQPGGSLRL SCAASGFTFS SqQMVWVRQA PGKGLEWVSY ISPSGGNTYY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-H01          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-H01          HC
EVQLLESGGG LVQPGGSLRL SCAASGFTFS NYTMQWVRQA PGKGLqWVSY ISPSGGYTGY  60

ADSVKGRFTI SRDNSKNTLY LQMNSLRAED TAVYYCARVA RGIAARSRTS YFDYWGQGTL 120

VTVSSASTKG PSVFPLAPSS KS                                     142

M205-H08          LC
QDIQMTQSPG TLSLSPGERA TLSCRTSQFV NSNYLAWYQQ TPGQAPRLLI YGASSRATGI  60

PDRFSGTGYG TDFTLTISRL EPEDYGTYYC QQSSRTPWTF GQGTRVEIK         109

M205-H08          HC
EVQLLESGGG LVQPGGSLRL SCAASGFTFS DYMMMWVRQA PGKGLEWVSS IVPSGGHTqY  60

ADSVKGRFTI SRDNSKNTLY LQMNSLRAED TAVYYCARVA RGIAARSRTS YFDYWGQGTL 120

VTVSSASTKG PSVFPLAPSS KS                                     142
```

```
M206-A06             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-A06             HC
EVQLLESGGG LVQPGGSLRL SCAASGFTFS NYMMGWVRQA PGKGLqWVSS ISPSGGLTKY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-B10             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-B10             HC
EVQLLESGGG LVQPGGSLRL SCAASGFTFS qYLMAWVRQA PGKGLEWVSS IYPSGGWTKY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-C03             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-C03             HC
EVQLLESGGG LVQPGGSLRL SCAASGFTFS qYMMVWVRQA PGKGLEWVSS IYSSGGNTPY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-E02             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-E02             HC
EVQLLESGGG LVQPGGSLRL SCAASGFTFS EYMMMWVRQA PGKGLEWVSV ISPSGGQTHY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-F01             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-F01             HC
EVQLLESGGG LVQPGGSLRL SCAASGFTFS GYMMVWVRQA PGKGLEWVSR ISPSGGPTIY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-F09             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-F09             HC
EVQLLESGGG LVQPGGSLRL SCAASGFTFS VYMMSWVRQA PGKGLEWVSS IVPSGGSTTY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-H01             LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK             109

M206-H01             HC
EVQLLESGGG LVQPGGSLRL SCAASGFTFS EYMMVWVRQA PGKGLEWVSR ISPSGGTTEY   60

ADSVKGRFTI SRDNSKNTLY LQMNSLRAED TAVYYCARVA RGIAARSRTS YFDYWGQGTL  120
```

-continued

```
VTVSSASTKG PSVFPLAPSS KS                                          142

M206-H04          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M206-H04          HC
EVQLLESGGG LVQPGGSLRL SCAASGFTFS SYMMVWVRQA PGKGLEWVSS ISPSGGYTIq   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-H05          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M206-H05          HC
EVQLLESGGG LVQPGGSLRL SCAASGFTFS GYKMqWVRQA PGKGLEWVSS ISPSGGITMY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M206-H08          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M206-H08          HC
EVQLLESGGG LVQPGGSLRL SCAASGFTFS DYMMAWVRQA PGKGLEWVSS IVPSGGHTHY   60

ADSVKGRFTI SRDNSKNTLY LQMNSLRAED TAVYYCARVA RGIAARSRTS YFDYWGQGTL  120

VTVSSASTKG PSVFPLAPSS KS                                          142

M207-A01          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M207-A01          HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA RGISARSRTS CFDYWGQGTL  120

VTVSSASTKG PSVFPLAPSS KS                                          142

M207-A02          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M207-A02          HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TALYYCARVA RGIAARSRTI NLDYWGQGTL  120

VTVSSASTKG PSVFPLAPSS KS                                          142

M207-A04          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M207-A04          HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA RGIAARSRTR SFDYWGQGTL  120

VTVSSASTKG PSVFPLAPSS KS                                          142

M207-C05          LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

R0121-D02 = M0207-C05              HC
```

-continued

```
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS YFDKWGQGTL   120

VTVSSASTKG PSVFPLAPSS KS                                           142

M208-A10            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-A10            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS qFDHWGQGTL   120

VTVSSASTKG PSVFPLAPSS KS                                           142

M208-B01            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-B01            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FFDqWGQGTL   120

VTVSSASTKG PSVFPLAPSS KS                                           142

M208-C06            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-C06            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FIDYWGQGTL   120

VTVSSASTKG PSVFPLAPSS KS                                           142

M208-D12            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-D12            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARLA RGIAARSRTS YqDIWGQGTL   120

VTVSSASTKG PSVFPLAPSS KS                                           142

M208-E10            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-E10            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA QGISARSRTS YFDYWGQGTL   120

VTVSSASTKG PSVFPLAPSS KS                                           142

M208-F04            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M208-F04            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FFDYWGQGTL   120

VTVSSASTKG PSVFPLAPSS KS                                           142

M208-F10            LC
QDIQMTQSPG TLSLSPGERA TLSCRTSQFV NSNYLAWYQQ TPGQAPRLLI YGASSRATGI    60
```

-continued

```
                         PDRFSGTGYG TDFTLTISRL EPEDYGTYYC QQSSRTPWTF GQGTRVEIK      109

M208-F10            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YFDqWGQGTL      120

VTVSSASTKG PSVFPLAPSS KS                                               142

M208-G02            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M208-G02            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIADRSRTS YSDYWGQGTL      120

VTVSSASTKG PSVFPLAPSS KS                                               142

M208-G03            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M208-G03            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YLDYWGQGTL     120

VTVSSASTKG PSVFPLAPSS KS                                               142

M208-H02            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M208-H02            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIASRSRTR YCDYWGQGTL     120

VTVSSASTKG PSVFPLAPSS KS                                               142

M209-B01            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M209-B01            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIVARSRTS NFDqWGQGTL     120

VTVSSASTKG PSVFPLAPSS KS                                               142

M209-B09            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M209-B09            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA QGIVARSRTS YLHqWGQGTL     120

VTVSSASTKG PSVFPLAPSS KS                                               142

M209-B11            LC
QDIQMTQSPG TLSLSPGERA TLSCRTSQFV NSNYLAWYQQ TPGQAPRLLI YGASSRATGI      60

PDRFSGTGYG TDFTLTISRL EPEDYGTYYC QQSSRTPWTF GQGTRVEIK                  109

M209-B11            HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTR YIDqWGQGTL     120

VTVSSASTKG PSVFPLAPSS KS                                               142
```

```
M209-C02           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-C02           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAYRRRTS YFDYWGQTL   120

VTVSSASTKG PSVFPLAPSS KS                                          142

M209-C11           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-C11           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCAMVG QGIRGRSRTS YFAqWGQGTL  120

VTVSSASTKG PSVFPLAPSS KS                                          142

M209-C12           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-C12           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS qLDYWGQGTL  120

VTVSSASTKG PSVFPLAPSS KS                                          142

M0209-D02          LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-D02           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGITARSRTS YFDDWGQGTL  120

VTVSSASTKG PSVFPLAPSS KS                                          142

M209-D03           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-D03           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS FFDqWGQGTL  120

VTVSSASTKG PSVFPLAPSS KS                                          142

M209-D12           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-D12           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCATVA RGIAARSRTS YFDqWGQGTL  120

VTVSSASTKG PSVFPLAPSS KS                                          142

M209-E02           LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M209-E02           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTI LLDqWGQGTL  120
```

-continued

```
VTVSSASTKG PSVFPLAPSS KS                                           142

M209-E03              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-E03              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARqA RGIAARSRTS YFDYWGQGTL  120

VTVSSASTKG PSVFPLAPSS KS                                           142

M209-F04              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-F04              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA RGIAARSRTS YLDqWSQGTL  120

VTVSSASTKG PSVFPLAPSS KS                                           142

M209-G01              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-G01              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA qGISGRSRLS YVDYWGQGTL  120

VTVSSASTKG PSVFPLAPSS KS                                           142

M209-G07              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-G07              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA RGIAARSRTS YFDTWGQGTL  120

VTVSSASTKG PSVFPLAPSS KS                                           142

M209-H03              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-H03              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA QGIAARSRTT qFDYWGQGTL  120

VTVSSASTKG PSVFPLAPSS KS                                           142

M209-H07              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-H07              HC
EVQLLESGGG LVQPGGSLRL SCAASGFTFS HYLMTWVRQA PGKGLEWVSY ISPSGGHTIY   60

ADSVKGRFTI SRDNSKNTLY LQMNSLRAED TAVYYCARVA RGIAARqRTS YYDYWGQGTL  120

VTVSSASTKG PSVFPLAPSS KS                                           142

M209-H09              LC
QDIQMTQSPG TLSLSPGERA TLSCRTSQFV NSNYLAWYQQ TPGQAPRLLI YGASSRATGI   60

PDRFSGTGYG TDFTLTISRL EPEDYGTYYC QQSSRTPWTF GQGTRVEIK              109

M209-H09              HC
```

```
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTV YFDHWGQGTL   120

VTVSSASTKG PSVFPLAPSS KS                                           142

M210-A06            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-A06            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS qFDYWGQGTL   120

VTVSSASTKG PSVFPLAPSS KS                                           142

M210-B02            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-B02            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCASVA RGIAARSRTS YFNqWGQGTL   120

VTVSSASTKG PSVFPLAPSS KS                                           142

M210-C12            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-C12            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA QGIAARSRTS SVDqWGQGTL   120

VTVSSASTKG PSVFPLAPSS KS                                           142

M210-G04            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-G04            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA TGIVARSRTR YFDqWGQGTL   120

VTVSSASTKG PSVFPLAPSS KS                                           142

M210-G10            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-G10            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YLDFWGQGTL   120

VTVSSASTKG PSVFPLAPSS KS                                           142

M210-H01            LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-H01            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRNS qQDYWGQGTL   120

VTVSSASTKG PSVFPLAPSS KS                                           142

M210-H06            LC
QDIQMTQSPG TLSLSPGERA TLSCRTSQFV NSNYLAWYQQ TPGQAPRLLI YGASSRATGI    60
```

```
                              -continued
PDRFSGTGYG TDFTLTISRL EPEDYGTYYC QQSSRTPWTF GQGTRVEIK            109

M210-H06              HC
EVQLLESGGG LVQPGGSLRL SCAASGFTFS HYLMTWVRQA PGKGLEWVSY ISPSGGHTIY 60

ADSVKGRFTI SRDNSKNTLY LQMNSLRAED TAVYYCARVA RGIAARSRTR YFDYWGQGTL 120

VTVSSASTKG PSVFPLAPSS KS                                        142

M210-H07              LC
QDIQMTQSPG TLSLSPGERA TLSCRTSQFV NSNYLAWYQQ TPGQAPRLLI YGASSRATGI 60

PDRFSGTGYG TDFTLTISRL EPEDYGTYYC QQSSRTPWTF GQGTRVEIK            109

M210-H07              HC
EVQLLESGGG LVQPGGSLRL SCAASGFTFS HYLMTWVRQA PGKGLEWVSY ISPSGGHTIY 60

ADSVKGRFTI SRDNSKNTLY LQMNSLRAED TAVYYCARVA RGIAARSRTR YFDqWGQGTL 120

VTVSSASTKG PSVFPLAPSS KS                                        142
```

Example 6

In Vivo Testing of M162-A04 (IgG) and X101-A01

Figure 2:
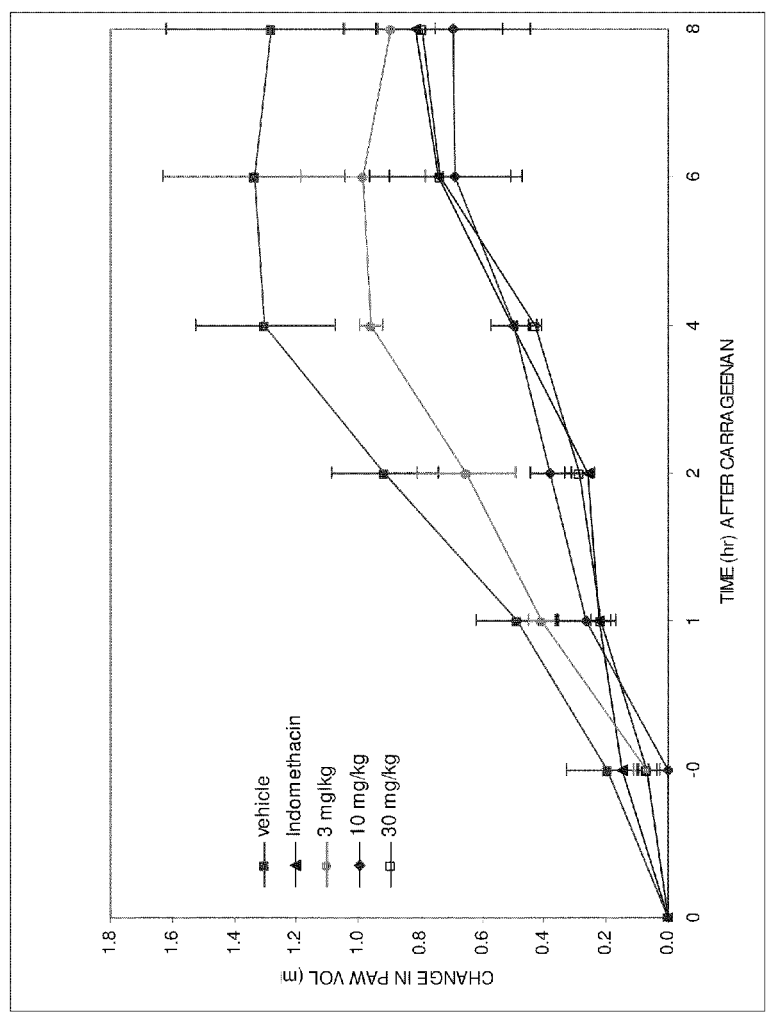
FIG. 2 depicts the effect of M162-A04 on carrageenan-induced rat paw edema. Paw swelling was measured by water displacement.
Figure 3:
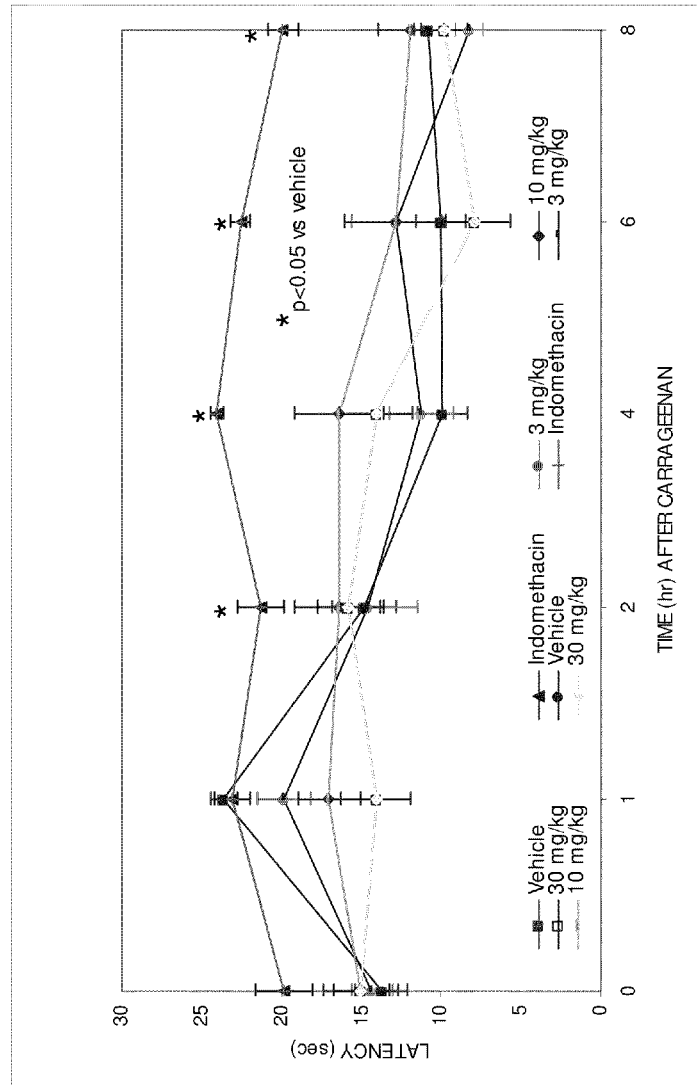
FIG. 3 depicts the effect of M162-A04 on carrageenan-induced thermal hyperalgesia. Pain latency was measured by the Hargreaves method after carrageenan injection.

Bradykinin and other bioactive kinins have been previously implicated in carrageenan-induced edema and inflammatory pain (Sharma J. N. et al. (1998) Inflammopharmacology 6, 9-17; Asano M. et al. (1997) Br J Pharmacol 122, 1436-1440; De Campos R. O. et al. (1996) Eur J Pharmacol 316, 277-286). Plasma kallikrein and tissue kallikrein 1 are the two primary kininogenases in mammals (Schmaier A. H. (2008) Int Immunopharmacol 8, 161-165). M162-A04 (M162-A4) (IgG), a specific plasma kallikrein inhibitor, was tested to determine whether it would be effective in carrageenan induced edema. The study design is outlined in Table 10. The route of administration (ROA) for the vehicle (PBS), the antibody, and the positive control (indomethacin) was intra-peritoneal (IP) and was given 30 minutes prior to carrageenan injection (0.1 mL of a 2% carrageenan solution). It is evident from FIG. 2 that antibody doses at 10 mg/kg and above were equally effective in reducing carrageenan-induced edema as the positive control (indomethacin). However, the antibody was not effective in reducing carrageenan-induced thermal hyperalgesia (FIG. 3). The reason for the dissociation between effectiveness in edema and hyperalgesia are not obvious but may be due to differences in the bioactivity of different kinin metabolites. Lys-desArg9-bradykinin is the most potent agonist of the B1 receptor, which is believed to be primarily involved in pain hypersensitivity (Leeb-Lundberg L. M et al. (2005) Pharmacol Rev 57, 27-77). This kinin metabolite is generated by tissue kallikrein 1, not plasma kallikrein (Schmaier A. H. (2008) Int Immunopharmacol 8, 161-165). This difference in kinin generation and resulting bradykinin receptor activation may account for the unexpected decoupling of edema and hyperalgesia in this model.

Figure 14:
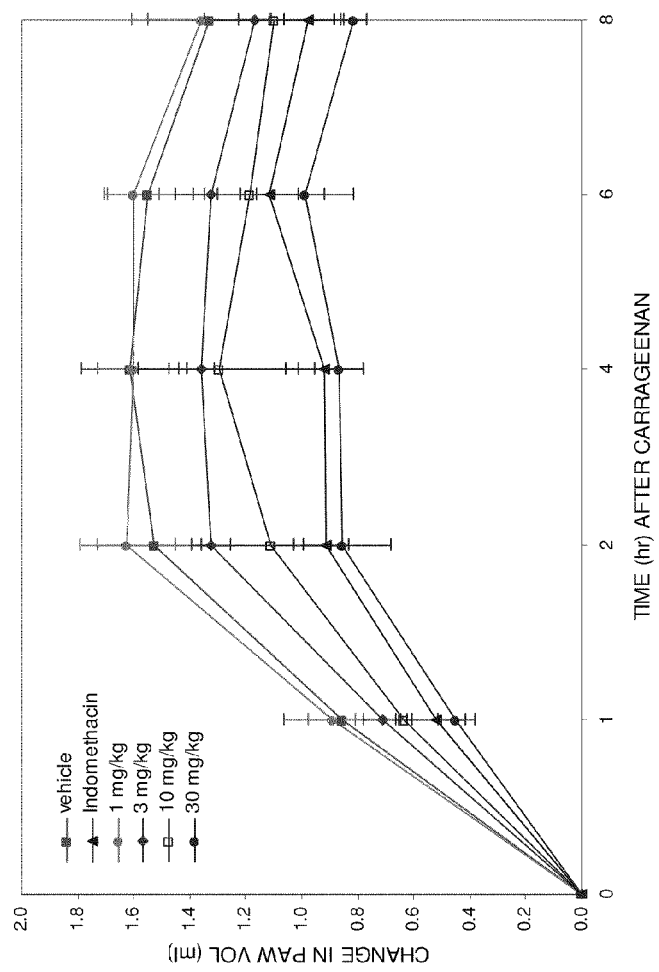
FIG. 14 depicts a graph showing dose dependent inhibition of edema by X101-A01 in carrageenan-induced paw edema (CPE) in rats.

Another pKal antibody inhibitor X101-A01 was also tested in the CPE model using the study design shown in Table 10B. The data obtained in FIG. 14 shows that X101-A01 inhibited edema in a dose-dependent manner to an extent that is comparable to that of the positive control (indomethacin).

TABLE 10A

Carrageenan-Induced Paw Edema Study Design to test M162-A04

| Group # | Number of Rats | Treatment | Dose (mg/kg) | ROA | Timing relative to carrageenan | Dose Volume (mL/kg) |
|---|---|---|---|---|---|---|
| 1 | 6 | Vehicle | N/A | IP | T −30 minutes | 20 |
| 2 | 6 | 559A-M162-A4 | 3 | IP | T −30 minutes | 20 |
| 3 | 6 | 559A-M162-A4 | 10 | IP | T −30 minutes | 20 |
| 4 | 6 | 559A-M162-A4 | 30 | IP | T −30 minutes | 20 |
| 5 | 6 | Indomethacin | 5 | IP | T −30 minutes | 20 |

TABLE 10B

Carrageenan-Induced Paw Edema Study Design to Test X101-

| Group | Treatment | n | Dose (mg/Kg) | ROA | Timing * | Vol (mL/Kg) |
|---|---|---|---|---|---|---|
| 1 | Vehicle | 10 | N/A | IP | −30 min | 20 |
| 2 | X101-A01 | 10 | 1 | IP | −30 min | 20 |
| 3 | X101-A01 | 10 | 3 | IP | −30 min | 20 |
| 4 | X101-A01 | 10 | 10 | IP | −30 min | 20 |
| 5 | X101-A01 | 10 | 30 | IP | −30 min | 20 |
| 6 | Indomethacin | 10 | 5 | IP | −30 min | 20 |

Example 7

Evaluation of Selected Antibody Inhibitors of Plasma Kallikrein

Evaluation of selected optimized antibodies (X81-B01 and X67-D03) is shown in Table 11. Neither antibody has any putative deamidation, isomerization, or oxidation sites.

TABLE 11

| Criteria | X81-B01 (IgG) | X67-D03 (IgG) |
|---|---|---|
| < nM Ki, app against human pKal | 0.2 nM | 0.1 nM |
| < nM Ki, app against rodent pKal | mouse - 11 pM<br>rat - 0.14 nM | mouse - 0.7 nM<br>rat - 0.34 nM |

TABLE 11-continued

| Criteria | X81-B01 (IgG) | X67-D03 (IgG) |
|---|---|---|
| prekallikrein binding | no | no |
| Specific inhibitor with respect to fXIa, plasmin, and trypsin | yes | yes |
| Inhibits bradykinin generation | yes | yes |
| Inhibits pKal in presence of prekallikrein | yes | yes |
| Competition for binding with aprotinin | yes | yes |
| Stability in human serum | yes | nd* |

*not done; a parental form of this antibody was shown to be stable in serum

Example 8

Epitope Mapping

The region of pKal bound by selected anti-pKal antibodies was investigated using several methods. First, competition assays were used to determine whether the antibodies competed for binding to pKal with known active site-directed inhibitors. Second, antibodies were grouped according to whether they were inhibitors or just binders to pKal. Third, epitopes were investigated using synthetic peptides and peptidic structures based on the sequence and 3-dimensional structure of pKal. These peptidic structures are called "CLIPS" (Chemically Linked Peptides on Scaffolds) and the testing was performed by a fee for service company called Pepscan.

Fourth, antibodies were tested for their ability to inhibit pKal from other species, besides human, where the amino acid sequence of pKal has been determined in order to identify amino acids that may account for the differences in inhibition.

Competition Assays

Using a BIACORE® SPR assay antibodies of interest were tested for competition with a known active site inhibitor of pKal. EPI-KAL2 is potent ($K_{i,app}$=0.1 nM) active site inhibitor of pKal and a Kunitz domain inhibitor based on the first domain of tissue factor pathway inhibitor (Markland (1996) *Iterative optimization of high-affinity protease inhibitors using phage display. 2. Plasma kallikrein and thrombin.* Biochemistry. 35(24):8058-67). Kunitz domains are known active site inhibitors of serine proteases, such as pKal.

The sequence of EPI-KAL2 is:

```
EAMHSFCAFKADDGPCRAAHPRWFFNIFTRQCEEFSYGGCGGNQNRFESL
EECKKMCTRD (SEQ ID NO: 1850)
```

(amino acids in italics are those that differ from TFPI)

Figure 8A:
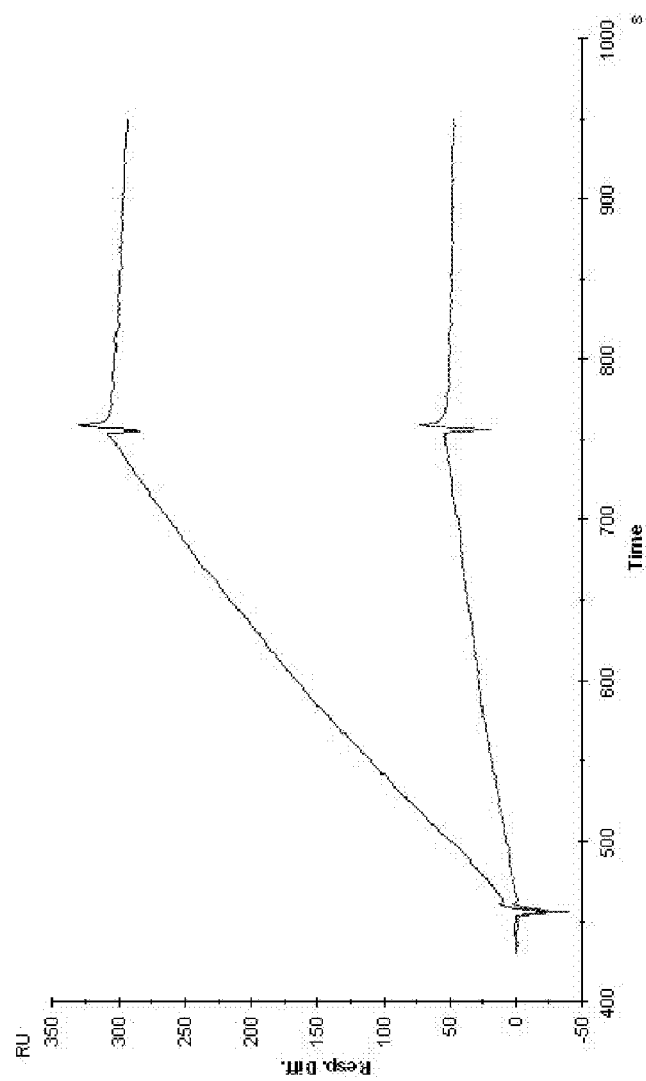
FIG. 8A depicts the EPI-KAL2 competition for X81-B01 binding pKal. X81-B01 (IgG) was captured on an anti-human Fc fragment specific surface of a CM5 BIACORE® chip. pKal (100 nM) was flowed over the surface in the presence (lower sensorgram in the figure) or absence of 1 µM EPI-KAL2 (upper sensorgram in the figure).
Figure 8B:
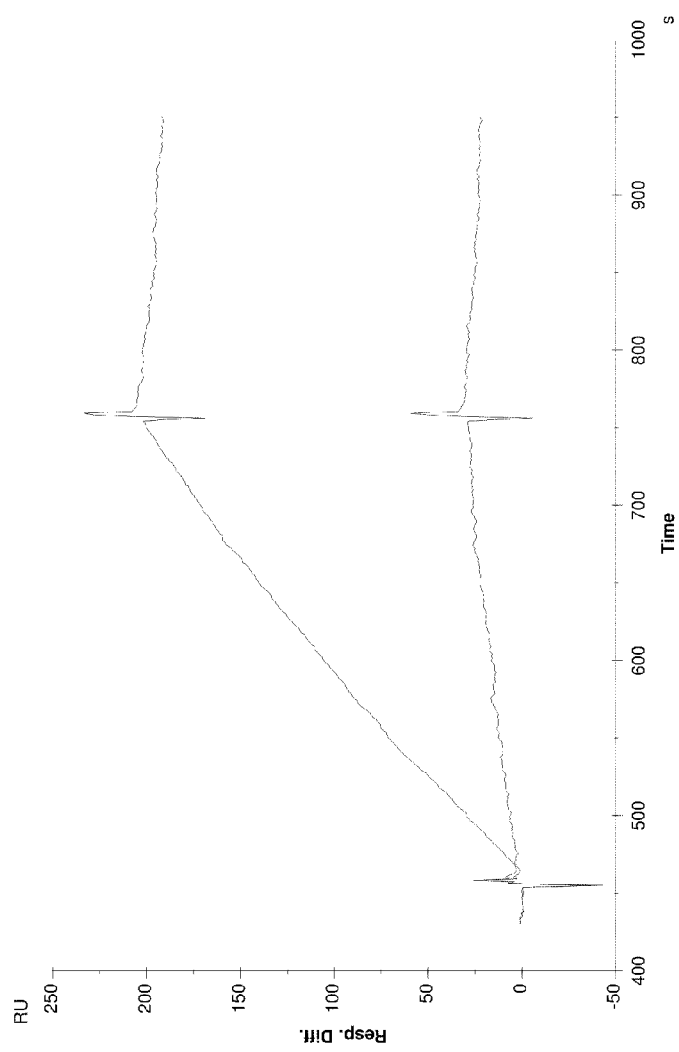
FIG. 8B depicts the EPI-KAL2 competition for X67-D03 binding pKal. X67-D03 (IgG) was captured on an anti-human Fc fragment specific surface of a CM5 Biacore chip. pKal (100 nM) was flowed over the surface in the presence (lower sensorgram in the figure) or absence of 1 µM EPI-KAL2 (upper sensorgram in the figure).

As shown in FIGS. 8A-8B, the antibodies X81-B01 and X67-D03 were competed for binding to pKal in the presence or EPI-KAL2. This result indicates that these antibodies either bind in vicinity of the active site or allosteric changes in the conformation of the pKal-EPI-KAL2 complex prevent antibody binding.

Antibody Binders vs Inhibitors

As shown in Tables 1 and 2, all the unique antibodies discovered by phage display were characterized as being either pKal inhibitors or binders but not inhibitors. Antibodies that inhibit the activity of pKal either bind near the active site and preclude substrate interactions (competitive inhibitors) or that bind away from the active site and induce allosteric changes in the structure of the active site (noncompetitive inhibitors). Antibodies that bind but do not inhibit pKal are unlikely to bind near the active site and may bind the non-catalytic domain (i.e. the apple domain). Table 12 categorizes selected antibodies as being either inhibitors or binders of pKal. Also shown in Table 12 for the listed antibodies, is a demonstration of whether they cross-react with mouse pKal as inhibitors and whether they bind prekallikrein.

TABLE 12

Binding Properties of Selected Anti-pKal Antibodies

| Number | Antibody | Binding Category | human Ki, app (nM) | mouse Ki, app (nM) | CLIPS Peptide(s) Identified |
|---|---|---|---|---|---|
| 1 | M6-A06 | 1) Binder only | no | no | C4 |
| 2 | M6-D09 | 2) inhibitor, prekallikrein binder, inhibits mouse and human pKal | 5.9 | 3.9 | C1, C5 |
| 3 | M8-C04 | 1) Binder only | no | no | |
| 4 | M8-G09 | 1) Binder only | no | no | C1, C4, C6, C7 |
| 5 | M29-D09 | 3) inhibitor, does not bind prekallikrein, does not inhibit mouse pKal | 0.7 | no | C1, C4, C7 |
| 6 | M35-G04 | 2) inhibitor, prekallikrein binder, inhibits mouse and human pKal | 2.9 | 8 | C1, C4 |
| 7 | M145-D11 | 3) inhibitor, does not bind prekallikrein, weak inhibitor of mouse pKal | 0.79 | 800 | C1, C4 |
| 8 | M160-G12 | 4) inhibitor of both mouse and human pKal, does not bind prekallikrein | 5 | 0.2 | C2 |
| 9 | X55-F01 | 4) inhibitor of both mouse and human pKal, does not bind prekallikrein | 0.4 | 2 | C2, C3 |
| 10 | X73-H09 | 4) inhibitor, does not bind prekallikrein, weak inhibitor of human and mouse pKal | 20 | 70 | C6 |
| 11 | X81-B01 | 4) inhibitor of both mouse and human pKal, does not bind prekallikrein | 0.1 | 0.011 | C2, C3, C5, C6 |
| 12 | A2 | 5) Negative control, does not bind pKal, binds streptavidin | No binding | No binding | No binding |

C1-C7: peptides in pKal identified by CLIPS epitope mapping (see FIGS. 9 and 10A-10C). C1 corresponds to positions 55-67 of the catalytic domain, C2 to positions 81-94, C3 to positions 101-108, C4 to positions 137-151, C5 to positions 162-178, C6 to positions 186-197, and C7 to positions 214-217.

Epitope Mapping Using CLIPS

The 11 anti-pKal antibodies listed in Table 12, plus one negative control (A2) were tested for binding to 5000 different synthetic CLIPS (Chemically Linked Peptides on Scaffolds) by Pepscan as described below in the CLIP METHODS sections. This analysis led to the identification of peptide regions in pKal that are likely to be a part of the antibody epitope for each of the tested antibodies (FIG. 9).

CLIPS Methods

The linear and CLIPS peptides were synthesized based on the amino acid sequence of the target protein using standard Fmoc-chemistry and deprotected using trifluoric acid with scavengers. The constrained peptides were synthesized on chemical scaffolds in order to reconstruct conformational epitopes, using Chemically Linked Peptides on Scaffolds (CLIPS) technology (Timmerman et al. (2007). For example, the single looped peptides were synthesized containing a dicysteine, which was cyclized by treating with alpha, alpha'-dibromoxylene and the size of the loop was varied by introducing cysteine residues at variable spacing. If other cysteines besides the newly introduced cysteines were present, they were replaced by alanine. The side-chains of the multiple cysteines in the peptides were coupled to CLIPS templates by reacting onto credit-card format polypropylene PEPSCAN cards (455 peptide formats/card) with a 0.5 mM solution of CLIPS template such as 1,3-bis(bromomethyl)benzene in ammonium bicarbonate (20 mM, pH 7.9)/acetonitrile (1:1(v/v)). The cards were gently shaken in the solution for 30 to 60 minutes while completely covered in solution. Finally, the cards were washed extensively with excess of $H_2O$ and sonicated in distrupt-buffer containing 1 percent SDS/0.1 percent beta-mercaptoethanol in PBS (pH 7.2) at 70° C. for 30 minutes, followed by sonication in $H_2O$ for another 45 minutes. The binding of antibody to each peptide were tested in a PEPSCAN-based ELISA. The 455-well credit card format polypropylene cards containing the covalently linked peptides were incubated with primary antibody solution for example consisting of 1 micrograms/mL diluted in blocking solution called SQ (4% horse serum, 5% ovalbumin (w/v) in PBS/1% Tween or diluted in PBS e.g., 20% SQ) overnight. After washing, the peptides were incubated with a 1/1000 dilution of rabbit anti-human antibody peroxidase or goat-anti-human FAB peroxidase for one hour at 25° C. After washing, the peroxidase substrate 2,2'-azino-di-3-ethylbenzthiazoline sulfonate (ABTS) and 2 microliters of 3 percent $H_2O_2$ were added. After one hour, the color development was measured. The color development was quantified with a charge coupled device (CCD)—camera and an image processing system (as firstly described in Slootstra et al., 1996).

Data Calculation

Raw Data: Optical density (Arbitrary OD units)

The raw data are optical values obtained by a CCD-camera. The values mostly range from 0 to 3000, a log scale similar to 1 to 3 of a standard 96-well plate elisa-reader. First the CCD-camera makes a picture of the card before peroxidase coloring and then again a picture after the peroxidase coloring. These two pictures are subtracted from each other which results in the data which is called raw-data. This is copied into the Peplab™ database. Then the values are copied to excel and this file is labeled as raw-data file. One follow-up manipulation is allowed. Sometimes a well contains an air-bubble resulting in a false-positive value, the cards are manually inspected and any values caused by an air-bubble are scored as 0.

Normally assays are not done in replicate (only upon request client request). Replicate tests are usually very similar. In addition, the dataset of thousands of peptides contains many peptides that are similar, thus results are never based on recognition of one peptide but on families of similar peptides. If one or a few peptides do not bind, or exhibit lower binding, in a replicate experiment, a different epitope mapping is not normally attributed.

Timmerman et al. (2007). Functional reconstruction and synthetic mimicry of a conformational epitope using CLIPS™ technology. *J. Mol. Recognit.* 20:283-99

Slootstra et al. (1996). Structural aspects of antibody-antigen interaction revealed through small random peptide libraries, *Molecular Diversity*, 1, 87-96.

Example 9

Analysis of pKal Sequences from Different Species

All available sequence of pKal were obtained from public databases and aligned using ClustalW and regions were highlighted based on solvent accessibility, contact with an active site Kunitz inhibitor, and those peptides identified by CLIPS analysis (FIGS. 10A-10C). Citrated plasma from each of these species was obtained and activated using a commercially available prekallikrein activator (from Enzyme Research Laboratories) according to the instructions of the manufacturer. Kallikrein activity was then measured in each of the samples in the presence or absence of X81-B01.

It was found that X81-B01 inhibited pKal from all the species except for pig pKal. Since the CLIPS analysis identified four peptides of pKal that X81-B01 binds to—C2 (positions 81-94), C3 (positions 101-108), C5 (positions 162-178) and C6 (positions 186-197)—differences in the pig pKal sequence that correspond to these peptides were examined to identify potential amino acids changes that account for the lack of inhibition of pig pKal by X81-B01. Peptides C2 and C3 are close in the sequence and are both highly similar in sequence among the different species. However, there is a difference at position 479. All the species except pig, frog, and dog have a serine at position 479. The frog and dog pKal sequence has an alanine and a threonine at position 479, respectively; both of which are considered conservative substitutions for a serine. In contrast, the pig pKal sequence has a leucine at position 479, which is a considerably less conservative substitution for a serine. Peptide C5 in pig pKal is highly similar to the sequences from the other species. However, at position 563, only in the pig pKal is a histidine present (bold in FIG. 10C). This position in all the other species, except frog, is a tyrosine. In the frog pKal, which is inhibited by X81-B01, this position is a threonine. Peptide C6 in pig pKal is again highly similar to the other sequences. However, only in the pig pKal sequence is position 585 a glutamate (in bold in FIG. 10C). In all the other species this position is an aspartate. This analysis may indicate potentially critical residues in pKal that interact with X81-B01.

Example 10

In Vitro and In Vivo Assays to Assess Efficacy of a Plasma Kallikrein Binding Protein Binding to prekallikrein vs. kallikrein:

The advantage of an antibody inhibitor of pKal that does not bind prekallikrein over an antibody that binds prekallikrein can be demonstrated experimentally. For example, an in vitro experiment can be designed to compare the potency of a pKal antibody inhibitor that does not bind prekallikrein (e.g. DX-2922) with one that binds prekallikrein (e.g. M6-D09) using an activated partial thromboplastin time (APTT) plasma clotting time assay. The APTT assay induces clotting in plasma by the addition of a reagent that specifically activates the contact system component of the intrinsic coagulation pathway, of which the activity of pKal is involved. It is well known in the literature that the inhibition of pKal or that a genetic deficiency in pKal leads to prolonged aPPT (see e.g., Morishita, H., et al., Thromb Res, 1994. 73(3-4): p. 193-204; Wynne Jones, D., et al., Br J Haematol, 2004. 127 (2): p. 220-3). An in vitro experiment can be performed to measure the effect of spiking citrated human plasma with different concentrations of either M6-D09 or DX-2922 on observed clotting times induced using commercially available APTT reagents and a coagulation analyzer (Table 13). It is expected that the observed EC50 for APTT prolongation of M6-D09 will be significantly higher than that of DX-2922 due to the binding of M6-D09 to the high concentration prekallikrein (~500 nM) in the normal plasma sample. Efficacy of the antibody inhibitor of pKal as demonstrated by prolonging APTT supports the potential therapeutic use of the antibody in treating or preventing cardiovascular disease associated with aberrant clot formation, such as may be observed in atherosclerosis, stroke, vasculitis, aneurism, and patients implanted with ventricular assist devices.

TABLE 13

Study Design to Measure Effect of Antibody Inhibitors of pKal on APTT

| Condition | Observed Effect on APPT |
|---|---|
| No treatment, just plasma | Normal |
| Prekallikrein depleted plasma control (commercially available) | Maximum prolongation |
| M6-D09 at low concentration | Normal |
| M6-D09 at middle concentration | Normal |
| M6-D09 at high concentration | Prolonged APTT |
| DX-2922 at low concentration | Prolonged APTT |
| DX-2922 at middle concentration | Prolonged APTT |
| DX-2922 at high concentration | Maximum prolongation |

Efficacy in a Rat Model of Edema:

An in vivo experiment can also be conducted to demonstrate the increased potency of an antibody inhibitor of pKal that does not bind prekallikrein. The carrageenan-induced paw edema (CPE) model of edema in rats is a common pharmacology model. A group of rats will be treated with escalating doses of M6-D09 and DX-2922 by intraperitoneal (IP) injection prior to injecting carrageenan (e.g. 0.1 mL of a 10% w/v solution) in the paws of the rats (Table 14). It is expected that DX-2922 will be more effective in reducing the observed paw swelling than M6-D09. Efficacy of the antibody supports the therapeutic use of the antibody in various inflammatory diseases that are associated with either swelling (e.g. hereditary angioedema, stroke induced edema, brain edema) or bradykinin mediated inflammation and pain (e.g. rheumatoid arthritis, inflammatory bowel disease).

TABLE 14

Study Design to Observe Effect of Antibody Inhibitors on CPE

| Group | Treatment | Example Dose (mg/Kg) | Effect Expected |
|---|---|---|---|
| 1 | Vehicle | N/A | Maximum swelling |
| 2 | Indomethacin (positive control) | 5 | Maximum reduction of swelling |
| 3 | M6-D09 | 1 | No effect on swelling |
| 4 | M6-D09 | 3 | No effect on swelling |
| 5 | M6-D09 | 10 | Intermediate reduction of swelling |
| 6 | DX-2922 | 1 | No effect on swelling |
| 7 | DX-2922 | 3 | Intermediate reduction of swelling |
| 8 | DX-2922 | 10 | Maximum reduction of swelling |

Measuring Half-Life:

The pharmacokinetic properties of DX-2922 will be determined in rats and cynomolgus monkeys in a study design outlined in Table 15. Serum will be collected at the times indicated following IV injection of DX-2922. The concentration of DX-2922 will be determined by ELISA and plotted versus time in order to obtain pharmacokinetic parameters (clearance, half life, volume of distribution, etc). It is expected that DX-2922 will have a half-life greater than 5 days in cynomolgus monkeys that will scale to a half life greater than 7 days in humans.

TABLE 15

A Pharmacokinetic study of plasma kallikrein inhibitor pKal administered by intravenous and subcutaneous routes to cynomolgus monkeys.

| Group | Treatment | Dosage Level (mg/kg/day) | Route | Number of Animals (sex) | Serum Collection |
|---|---|---|---|---|---|
| 1 | pKAL | 20 | IV | 4 (M) | Pre-dose 0.08, 0.25. 0.5, 1, 4, 24 hours Day 2, 3, 4, 5, 6, 7, 8, 9, 10, 11, 12, 13, 14 |
| 2 | pKAL | 20 | IV | 4 (M) | Pre-dose 0.08, 0.25. 0.5, 1, 4, 24 hours Day 2, 3, 4, 5, 6, 7, 8, 9, 10, 11, 12, 13, 14 |

Example 11

Epitope Mapping Using Amino Acid Mutations of pKal

Based on the epitope mapping studies described herein in Example 8, we inspected the published 3 dimensional model in the RCSB Protein Data Bank (available on the world wide web at rcsb.org; pdb code 2ANY) and identified a collection of sets of amino acids in surface accessible loops near the enzyme active site that we reasoned could interact with the antibody binding resulting in enzyme inhibition. These amino acids were substituted for alanine and the catalytic domain of each of the mutant was expressed in *Pichia pastoris* with a His tag fusion and purified by IMAC. Four different mutant pKal mutants were synthesized and tested:

Mutant 1: Amino acids S478, N481, S525, and K526 of the human kallikrein sequence (Accession No. NP_00883.2) were mutated to alanine. These amino acids were determined to be involved in substrate recognition (S3 subsite).

Mutant 2: Amino acid residues R551, Q553, Y555, T558 and R560 of the human kallikrein sequence (Accession No. NP_00883.2) were mutated to alanine. It was determined that these residues are involved in the active site substrate recognition (S1' subsite).

Mutant 3: Amino acids D572, K575, and D577 of the human kallikrein sequence (Accession No. NP_00883.2) were mutated to alanine. These amino acid residues are involved in substrate recognition (S1' subsite)

Mutant 4: Amino acids N395, S397 and S398 of the human kallikrein sequence (Accession No. NP_00883.2) were mutated to alanine. These residues are distal from the active site of plasma kallikrein.

Three of the 4 mutants (Mutant 1, 2, and 4) have similar activity to that of the wildtype catalytic domain of pKal. The amino acid substitutions in Mutant 3 yielded an inactive protein that was not recognized in SPR (Biacore) binding assays by any of the tested anti-pKal antibodies.

Figure 11A:
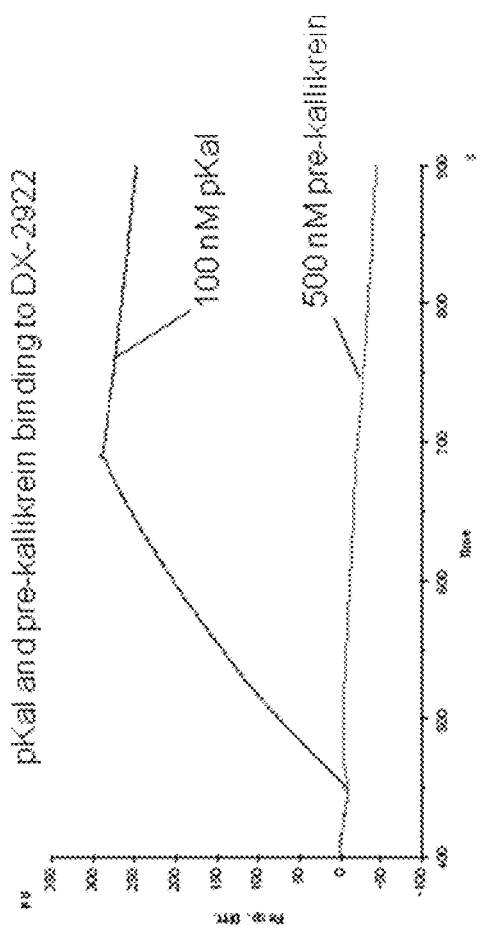
FIGS. 11A and 11B depict a Biacore competition analysis with epi-kal2, as described herein in Example 12, for (i) DX-2922, and (ii) M6-D09 antibodies.
Figure 11B:
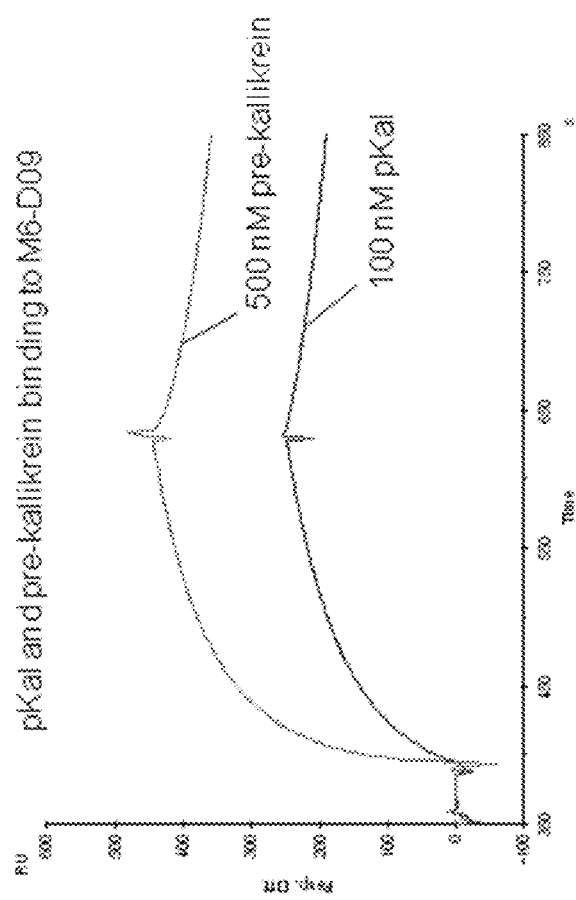

The antibodies tested for inhibition of mutants 1, 2 and 4 are shown herein in Table 16. Based on the measured $K_{i,app}$ values for the antibodies in Group 1 (i.e., antibodies that inhibit human and mouse pKal but do not bind prekallikrein) it is evident that this group of antibodies binds an epitope on pKal that contains the amino acids that were mutated in Mutant 2 but were not dependent on residues mutated in Mutants 1 or 4. In addition, the interaction of plasma kallikrein binding proteins X8'-B01/X101-A01/DX-2922 and affinity matured derivative X115-B07 to kallikrein is adversely affected by the substitutions in Mutant 1. For an example of the differences in the ability of the antibodies to bind prekallikrein see e.g., FIGS. 11A and 11B, which compares prekallikrein the binding of DX-2922 (Group 1) to that of M6-D09 (Group 3).

Figure 12:
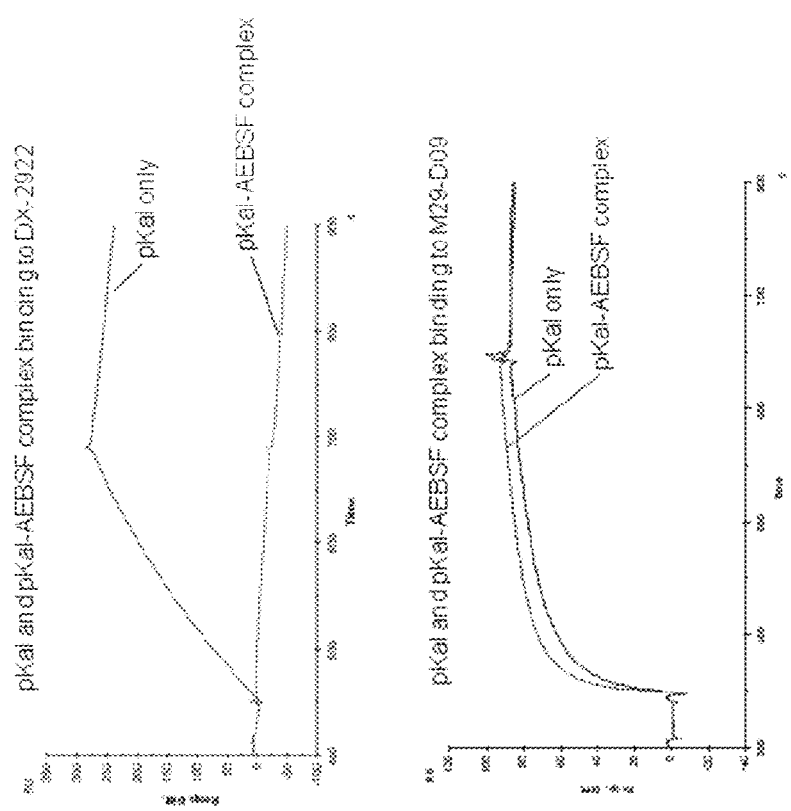
FIG. 12 depicts a Biacore competition analysis with AEBSF, as described herein in Example 12, for (i) DX-2911, and (ii) M6-D09 antibodies.
Figure 13:
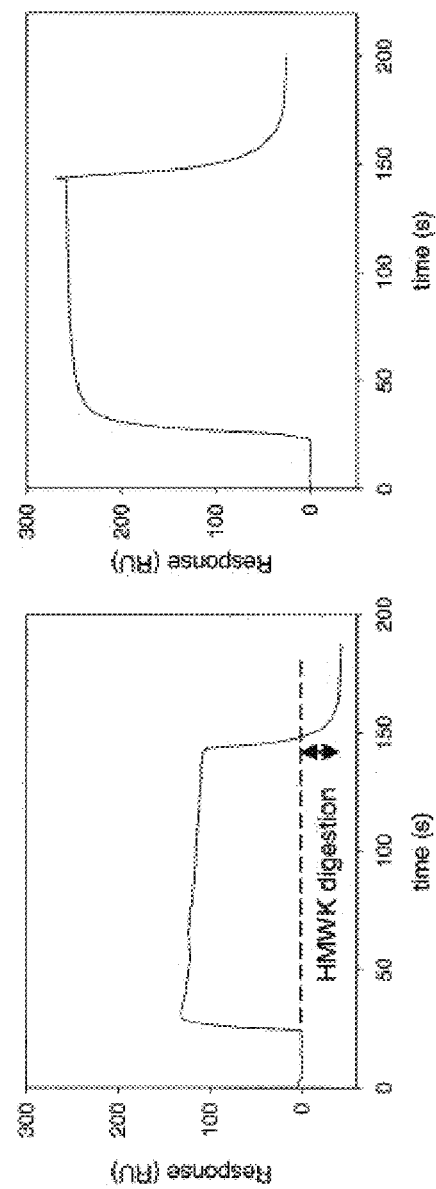
FIG. 13 depicts a Biocore analysis showing that DX-2922 binds to plasma kallikrein that bound to hign molecular weight kininogen (HMWK).

The antibodies in Group 2 (i.e., those that inhibit human pKal not mouse pkal and do not bind prekallikrein) were not significantly affected by the mutated amino acids indicating that they make contact with alternate amino acids. The Group 2 antibodies are likely to bind near the active site, as they were unable to bind pKal complexed with a Kunitz domain (EPI-KAL2), which are known to bind at the active site of a serine protease. Furthermore, one of the antibodies in Group 2 (M145-D11) is similar to those in Group 1 in that it is unable to bind pKal in a Biacore assay that is inactivated with the suicide inhibitor AEBSF (4-(2-Aminoethyl)benzenesulfonyl fluoride hydrochloride), which is a small molecule covalent inhibitor of trypsin-like serine proteases (FIG. 12). However, the other antibody (M29-D09) assigned to Group 2 was able to bind AEBSF inactivated pKal, indicating that it may bind a different epitope than M145-D11 despite sharing similar binding properties.

The antibodies in Group 3 inhibited human and mouse pKal but bound prekallikrein. One of these antibodies, M6-D09, was unable to bind pKal inactivated by either EPI-KAL2 or AEBSF, indicating that this group of pKal inhibitors interacts with alternative amino acids near the active site. The $K_{i,app}$ for M6-D09 increased approximately 5-fold towards Mutant 2 (i.e., decreased potency of M6-D09).

Example 12

Affinity Maturation

In addition to the affinity maturation described herein in Examples 4 and 5, which involved optimization of the light chain we attempted to further optimize affinity with libraries that vary amino acids in the CDR1, CDR2, and CDR3 regions of the variable heavy chain of two different parental anti-pKal antibodies. Both of the antibodies selected for further optimization (X63-G06 and M162-A04) exhibit desirable properties for further development as a therapeutic antibody inhibitor of plasma kallikrein; properties which include: a) complete inhibition of human and rodent plasma kallikrein and b) no binding to prekallikrein. In some embodiments, complete inhibition of human pKal is essential to block the activity of plasma kallikrein in disease uses. Inhibition of rodent pKal facilitates preclinical development including toxicity assessment. The lack of binding to prekallikrein is a highly desirable property for an antibody inhibitor of pKal to maximize the bioavailability of the antibody therapeutic towards active pKal target and to potentially reduce the dose required for efficacy.

Affinity maturation was performed using 4 different phage display libraries. For each parental antibody (e.g., I62-A04), a library was constructed that contained varied amino acid positions in both the CDR1 and the CDR2 of the heavy chain. An additional library was constructed for each of the two parental antibodies wherein positions in the CDR3 of the heavy chain were varied. Each of these 4 phage display libraries were selected (panned) with decreasing amounts of active pKal in each subsequent round in order to obtain high affinity antibodies. To minimize the appearance of prekallikrein binding in the selected antibody output libraries were initially depleted against immobilized prekallikrein. After screening as Fab fragments, we discovered the affinity matured antibodies shown in Table 16 (i.e. the antibodies with the identification number starting with "X115").

Four discovered antibodies (X115-B07, X115-D05, X115-E09, and X115-H06) are derived from the DX-2922 parental antibody (also known as X63-G06 as a Fab fragment, X81-B01 as an IgG produced in 293T cells, or X101-A01 as an IgG produced in CHO cells) were found to be potent pKal inhibitors. For comparison the amino acid sequence of DX-2922 is shown. It is evident that three of the affinity matured antibodies (X115-B07, X115-E09, and X115-H06) contain mutations in Hv-CDR3; whereas X115-D05 has a different Hv-CDR1/CDR2. Four other discovered antibodies (X115-F02, X115-A03, X115-D01, and X115-G04) are derived from the M162-A04 parental antibody. All 8 affinity matured antibodies do not bind prekallikrein.

TABLE 16

Summary of Affinity Matured Anti-pKal Antibodies Inhibition Constants (Ki, app) on Wild Type pKal Catalytic Domain and Mutants 1, 2, and 4[a].

| Isolate | WT cat. Domain Ki, app (nM) | Mutant 1 Ki, app (nM) | Mutant 2 Ki, app (nM) | Mutant 4 Ki, app (nM) | Competes with AEBSF | Competes with epi-kal2 | Characteristics |
|---|---|---|---|---|---|---|---|
| DX-2922 | 0.22 | 14 | 20 | 0.25 | y | y | inhibits human and mouse pKal; does not bind pre-kallikrein |
| 559A-X115-B07 (aff mat; X101-A01 parent) | 0.13 | 4.7 | 47 | 0.14 | y | nd | inhibits human and mouse pKal; does not bind pre-kallikrein |
| 559A-X115-D05 (aff mat; X101-A01 parent) | nd | nd | nd | nd | y | nd | inhibits human and mouse pKal; does not bind pre-kallikrein |
| 559A-X115-E09 (aff mat; X101-A01 parent) | nd | nd | nd | nd | y | nd | inhibits human and mouse pKal; does not bind pre-kallikrein |
| 559A-X115-H06 (aff mat; X101-A01 parent) | nd | nd | nd | nd | y | nd | inhibits human and mouse pKal; does not bind pre-kallikrein |
| 559A-X115-A03 (aff mat; M162-A04 parent) | 0.16 | 0.23 | 3.7 | 0.13 | y | nd | inhibits human and mouse pKal; does not bind pre-kallikrein |
| 559A-X115-D01 (aff mat; M162-A04 parent) | 0.18 | 0.26 | 2.5 | 0.12 | y | nd | inhibits human and mouse pKal; does not bind pre-kallikrein |

TABLE 16-continued

Summary of Affinity Matured Anti-pKal Antibodies Inhibition Constants (Ki, app) on Wild Type pKal Catalytic Domain and Mutants 1, 2, and 4[a].

| Isolate | WT cat. Domain Ki, app (nM) | Mutant 1 Ki, app (nM) | Mutant 2 Ki, app (nM) | Mutant 4 Ki, app (nM) | Competes with AEBSF | Competes with epi-kal2 | Characteristics |
|---|---|---|---|---|---|---|---|
| 559A-X115-F02 (aff mat; M162-A04 parent) | 0.09 | 0.14 | 5.9 | 0.1 | y | y | inhibits human and mouse pKal; does not bind pre-kallikrein |
| 559A-X115-G04 (aff mat; M162-A04 parent) | 0.3 | 0.4 | 2.2 | 0.3 | y | y | inhibits human and mouse pKal; does not bind pre-kallikrein |
| 559A-M29-D09 (sFab)) | 0.24 | 0.27 | 0.34 | 0.39 | nd | y | inhibits human and mouse pKal; does not inhibit mouse pKal; does not bind pre-kallikrein |
| 559A-M145-D11 (sFab) | 0.16 | 0.23 | 0.1 | 0.21 | y | y | inhibits human and mouse pKal; weakly inhibits mouse pKal; does not bind pre-kallikrein |
| 559A-M06-D09 | 2.5 | 3.4 | 13.5 | 2.9 | y | y | inhibits human and mouse pKal; binds pre-kallikrein |
| 559A-M35-G04 | 0.8 | 0.09 | 1.1 | 0.8 | nd | nd | inhibits human and mouse pKal; binds pre-kallikrein |

[a]Antibodies were obtained from HV-CDR1/2 and HV-CDR3 affinity maturation, purified and tested for inhibition of either wild type pKal catalytic domain (Note, the antibodies inhibited full length wild type pKal approximately equal to that of the wild type catalytic domain).

TABLE 17

| Isolate | LV-CDR1 | LV-CDR2 | LV-CDR3 | HV-CDR1 | HV-CDR2 | HV-CDR3 |
|---|---|---|---|---|---|---|
| DX-2922 | RTSQFVNSNYLA | GASSRAT | QQSSRTPWT | HYLMT | YISPSGGHTIYADSVKG | VARGIAARSRTSYFDY |
| X115-B07 | RTSQFVNSNYLA | GASSRAT | QQSSRTPWT | HYLMT | YISPSGGHTIYADSVKG | VGQGIRGRSRTSYFAQ |
| X115-D05 | RTSQFVNSNYLA | GASSRAT | QQSSRTPWT | DYMMA | SIVPSGGHTHYADSVKG | VARGIAARSRTSYFDY |
| X115-E09 | RTSQFVNSNYLA | GASSRAT | QQSSRTPWT | HYLMT | YISPSGGHTIYADSVKG | VAQGIAARSRTSSVDQ |
| X115-H06 | RTSQFVNSNYLA | GASSRAT | QQSSRTPWT | HYLMT | YISPSGGHTIYADSVKG | VAQGISARSRTSYFDY |
| M162-A04 | RASQSISSWLA | KASTLES | QQYNTYWT | HYIMM | GIYSSGGITVYADSVKG | RRTGIPRRDAFDI |
| X115-A03 | RASQSISSWLA | KASTLES | QQYNTYWT | HYIMM | GIYSSGGITVYADSVKG | RRIGVPRRDSFDM |
| X115-D01 | RASQSISSWLA | KASTLES | QQYNTYWT | IYSMH | SIYPSRGMTWYADSVKG | RRTGIPRRDAFDI |
| X115-F02 | RASQSISSWLA | KASTLES | QQYNTYWT | HYIMM | GIYSSGGITVYADSVKG | RRIGVPRRDEFDI |
| X115-G04 | RASQSISSWLA | KASTLES | QQYNTYWT | HYIMM | GIYSSGGITVYADSVKG | RRTGVPRRDEFDI |
| M29-D09 | SGNKLGDKYVA | QDTKRPS | QAWDSSIVI | WYTMV | YIYPSGGATFYADSVKG | GSYDYIWGFYSDH |
| M145-D11 | SGDKLGDKYTS | QDIKRPS | QAWDSPNARV | HYRMS | SIYPSGGRTVYADSVKG | DKFEWRLLFRGIGNDAFDI |
| M06-D09 | RASQSIRNYLN | AASTLQS | QQLSGYPHT | FYYMV | VIYPSGGITVYADSVKG | DKWAVMPPYYYYAMDV |
| M35-G04 | RASQSVSSYLA | DASNRAT | QQRSNWPRGFT | YYHMS | VISPSGGSTKYADSVKG | GGSSDYAWGSYRRPYYFDY |

| Isolate | Full length pKal Ki, app (nM) | WT cat. Domain Ki, app (nM) | Mutant 1 Ki, app (nM) | Mutant 2 Ki, app (nM) | Mutant 4 Ki, app (nM) | competes with AEBSF | competes with epi-kal2 | Group |
|---|---|---|---|---|---|---|---|---|
| DX-2922 | 0.2 | 0.22 | 14 | 20 | 0.25 | y | y | 1 |
| X115-B07 | 0.33 |  | 4.7 | 47 | 0.14 | y | nd | 1 |
| X115-D05 | 0.25 | nd | nd | nd | nd | y | nd | 1 |
| X115-E09 | 0.34 | nd | nd | nd | nd | y | nd | 1 |
| X115-H06 | 0.35 | nd | nd | nd | nd | y | nd | 1 |
| M162-A04 |  | nd | nd | nd | nd | y | y | 1 |

TABLE 17-continued

| | | | | | | | | |
|---|---|---|---|---|---|---|---|---|
| X115-A03 | 0.16 | 0.16 | 0.23 | 3.7 | 0.13 | y | nd | 1 |
| X115-D01 | 0.18 | 0.18 | 0.26 | 2.5 | 0.12 | y | nd | 1 |
| X115-F02 | 0.089 | 0.09 | 0.14 | 5.9 | 0.1 | y | y | 1 |
| X115-G04 | 0.6 | 0.3 | 0.4 | 2.2 | 0.3 | y | y | 1 |
| M29-D09 | 0.7 | 0.24 | 0.27 | 0.34 | 0.39 | n | y | 2 |
| M145-D11 | 0.79 | 0.16 | 0.23 | 0.1 | 0.21 | y | y | 2 |
| M06-D09 | 5.9 | 2.5 | 3.4 | 13.5 | 2.9 | y | y | 3 |
| M35-G04 | 2.9 | 0.8 | 0.09 | 1.1 | 0.8 | nd | nd | 3 |

Equilibrium $K_{i,app}$ Measurements.

Apparent Inhibition constants ($K_{i,app}$ values) were measured by pre-incubating enzyme and inhibitor solutions prior to initiating the reactions with substrate. Enzyme and inhibitor were pre-incubated for 2 hours at 30° C. in a 96-well plate by adding 10 μL of a 10× enzyme solution and 10 μL of 10× inhibitor solutions to 70 μL of reaction buffer. Reactions were initiated by the addition of 10 μL of a 10× concentrated stock of substrate, and were monitored at 30° C. in a fluorescence plate reader with the excitation and emission wavelengths set at 360 nm/460 nm, respectively. Kinetic data were acquired by the increase in fluorescence, and initial rates for each condition were plotted against the total inhibitor concentration. The data was fit to the following equation for tight binding inhibitors:

$$A = A_0 - A_{inh}\left(\frac{(K_{i,app} + Inh + E) - \sqrt{(K_{i,app} + Inh + E)^2 - 4 \cdot Inh \cdot E}}{2 \cdot E}\right) \quad \text{Eqn. 1}$$

Where A=initial rate observed at each inhibitor concentration; $A_o$=initial rate observed in the absence of inhibitor; $A_{inh}$=initial rate observed for the enzyme inhibitor complex; Inh=concentration of inhibitor; E=total enzyme concentration (treated as a floated parameter); and $K_{i,app}$=apparent equilibrium inhibition constant.

Groups of Antibody Inhibitors.

Antibodies in Group 1 inhibit human and mouse pKal but do not bind prekallikrein. Antibodies in Group 2 inhibit human but not mouse pKal and do not bind prekallikrein. Antibodies in Group 3 inhibit human and mouse pKal but bind prekallikrein.

Biacore Competition Analysis with an Exemplary Kallikrein Antibody, Epi-Kal2.

Epi-Kal2 is an antibody inhibitor of kallikrein that acts by binding to the active site of kallikrein (for sequence see Example 8). The Biacore competition analysis is used herein as an assay to determine whether a test kallikrein antibody binds to the same site as epi-kal2 and is assessed by measuring the competition (e.g., displacement) between epi-kal2 and the test antibody for binding to the active site.

Goat anti-human Fc fragment specific IgG or anti-human Fab IgG was immobilized by amine coupling on a CM5 sensor chip at immobilization densities of approximately 5000 RU. Anti-pKal antibodies or sFabs were captured on their respective surfaces by injecting a 50 nM solution of IgG/sFab for 1-2 minutes at 5 at μl/min. Human pKal (100 nM) or human pKal-ep-kal2 complex (100 nM hpKal that had been pre-incubated with 1 μM epi-kal2 for 1 hour at room temperature) were injected over the captured IgGs or sFabs for 5 minutes at 20-50 μl/min followed by a 5-10 minute dissociation phase. Binding responses were recorded at the end of the association phase. Anti-pKal IgGs or sFabs were considered to compete with epi-kal2 for binding to human pKal if binding of the pKal-epi-kal2 complex to anti-pKal antibodies was significantly reduced (>70%) as compared to an injection of hpKal only. The sensor chip surface was regenerated with a pulse of 10 mM glycine pH 1.5 at a flow rate of 1000 min. Measurements were performed at 25° C. using HBS-P (10 mM HEPES pH 7.4, 150 mM NaCl and 0.005% surfactant P20) as the running buffer. Results from the Biacore competition analysis for epi-Kal2 are shown herein in FIGS. 11A and 11B.

Biacore Competition Analysis with the Small Molecule Kallikrein Inhibitor, AEBSF.

AEBSF (i.e., 4-(2-aminoethyl)benzene sulfonyl fluoride hydrochloride) is a small molecule inhibitor of kallikrein. The Biacore competition analysis is used herein to determine whether a test antibody binds to the same site (or an overlapping site) utilized by AEBSF for kallikrein inhibition.

Goat anti-human Fc fragment specific IgG or anti-human Fab IgG was immobilized by amine coupling on a CM5 sensor chip at immobilization densities of approximately 5000 RU. Anti-pKal IgGs or sFabs were captured on their respective surfaces by injecting a 50 nM solution of IgG/sFab for 1-2 minutes at 5 at μl/min. Human pKal (100 nM) or human pKal-AEBSF complex (100 nM hpKal that had been pre-treated with 1 mM AEBSF for 1 hour at room temperature) were injected over the captured IgGs or sFabs for 5 minutes at 20-50 μl/min followed by a 5-10 minute dissociation phase. Binding responses were recorded at the end of the association phase. Anti-pKal IgGs or sFabs were considered to compete with AEBSF for binding to human pKal if binding of the pKal-AEBSF complex to anti-pKal antibodies was significantly reduced (>70%) as compared to an injection of hpKal only. The sensor chip surface was regenerated with a pulse of 10 mM glycine pH 1.5 at a flow rate of 100 μl/min. Measurements were performed at 25° C. using HBS-P (10 mM HEPES pH 7.4, 150 mM NaCl and 0.005% surfactant P20) as the running buffer. Results from the Biacore competition analysis for AEBSF are shown herein in FIG. 12.

The Following are Sequences for the Light Chain Variable Regions (LV), and Heavy Chain Variable Regions (HV) Regions for 8 Exemplary Affinity Matured Anti-pKal Antibodies (SEQ ID NOs: 1935-1990):
559A-M0029-D09-LV
QSALTQPPTVSVSPGQTARITCSGNKLGDKYVAWYQQKPGQSPMLVIYQDTKRPSRVSERFSGSNSANTAT

LSISGTQALDEADYYCQAWDSSIVIFGGGTRLTVL

559A-M0145-D11-LV
QSVLTQPPSVSVSPGQTASITCSGDKLGDKYTSWYQQRPGQSPVLVIYQDIKRPSGIPERFSGSNSGNTAT

LTISGTQAMDEADYYCQAWDSPNARVFGSGTKVTVL

559A-M0162-A04-LV
DIQMTQSPSTLSASVGDRVTITCRASQSISSWLAWYQQKPGKAPNLLIYKASTLESGVPSRFSGSGSGTEF

TLTISSLQPDDFATYYCQQYNTYWTFGQGTKVEIK

559A-X0101-A01-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-X0115-A03-LV
DIQMTQSPSTLSASVGDRVTITCRASQSISSWLAWYQQKPGKAPKLLIYKASTLESGVPSRFSGSGSGTEF

TLTISSLQPDDFATYYCQQYNTYWTFGQGTKVEIK

559A-X0115-B07-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-X0115-D01-LV
DIQMTQSPSTLSASVGDRVTITCRASQSISSWLAWYQQKPGKAPKLLIYKASTLESGVPSRFSGSGSGTEF

TLTISSLQPDDFATYYCQQYNTYWTFGQGTKVEIK

559A-X0115-D05-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-X0115-E09-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-X0115-F02-LV
DIQMTQSPSTLSASVGDRVTITCRASQSISSWLAWYQQKPGKAPKLLIYKASTLESGVPSRFSGSGSGTEF

TLTISSLQPDDFATYYCQQYNTYWTFGQGTKVEIK

559A-X0115-G04-LV
DIQMTQSPSTLSASVGDRVTITCRASQSISSWLAWYQQKPGKAPKLLIYKASTLESGVPSRFSGSGSGTEF

TLTISSLQPDDFATYYCQQYNTYWTFGQGTKVEIK

559A-X0115-H06-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-M0006-D09-LV
DIQMTQSPSSLSASVGDRVTITCRASQSIRNYLNWYQQKPGKAPNLLIYAASTLQSGVPARFSGSGSGTDF

TLTISSLQPEDFATYYCQQLSGYPHTFGQGTKLEIK

559A-M0035-G04-LV
QDIQMTQSPATLSLSPGERATLSCRASQSVSSYLAWYQQKPGQAPRLLIYDASNRATGIPARFSGSGSGTD

FTLTISSLEPEDFAVYYCQQRSNWPRGFTFGPGTKVDIK

559A-M0029-D09-HV
EVQLLESGGGLVQPGGSLRLSCAASGFTFSWYTMVWVRQAPGKGLEWVSYIYPSGGATFYADSVKGRFTIS

RDNSKNTLYLQMNSLRAEDTAVYYCAMGSYDYIWGFYSDHWGQGTLVTVSS

559A-M0145-D11-HV
EVQLLESGGGLVQPGGSLRLSCAASGFTFSHYRMSWVRQAPGKGLEWVSSIYPSGGRTVYADSVKGRFTIS

RDNSKNTLYLQMNSLRAEDTAVYYCAKDKFEWRLLFRGIGNDAFDIWGQGTMVTVSS

559A-M0162-A04-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRTGIPRRDAFDIWGQGTMVTVSS

559A-X0101-A01-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVARGIAARSRTSYFDYWGQGTLVTVSS

559A-X0115-A03-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAWRRIGVPRRDSFDMWGQGTMVTVSS

559A-X0115-B07-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCAMVGQGIRGRSRTSYFAQWGQGTLVTVSS

559A-X0115-D01-HV
EVQLLESGGGLVQPGGSLRLSCAASGFTFSIYSMHWVRQAPGKGLEWVSSIYPSRGMTWYADSVKGRFTIS

RDNSKNTLYLQMNSLRAEDTAVYYCAYRRTGIPRRDAFDIWGQGTMVTVSS

559A-X0115-D05-HV
EVQLLESGGGLVQPGGSLRLSCAASGFTFSDYMMAWVRQAPGKGLEWVSSIVPSGGHTHYADSVKGRFTIS

RDNSKNTLYLQMNSLRAEDTAVYYCARVARGIAARSRTSYFDYWGQGTLVTVSS

559A-X0115-E09-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVAQGIAARSRTSSVDQWGQGTLVTVSS

559A-X0115-F02-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRIGVPRRDEFDIWGQGTMVTVSS

559A-X0115-G04-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRTGVPRRDEFDIWGQGTMVTVSS

559A-X0115-H06-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVAQGISARSRTSYFDYWGQGTLVTVSS

559A-M0006-D09-HV
EVQLLESGGGLVQPGGSLRLSCAASGFTFSFYYMVWVRQAPGKGLEWVSVIYPSGGITVYADSVKGRFTIS

RDNSKNTLYLQMNSLRAEDTAVYYCARDKWAVMPPYYYYAMDVWGQGTTVTVSS

559A-M0035-G04-HV
EVQLLESGGGLVQPGGSLRLSCAASGFTFSYYHMSWVRQAPGKGLEWVSVISPSGGSTKYADSVKGRFTIS

RDNSKNTLYLQMNSLRAEDTAVYYCARGGSSDYAWGSYRRPYYFDYWGQGTLVTVSS

559A-M0029-D09 LV
CAGAGCGCTTTGACTCAGCCACCCACAGTGTCTGTGTCCCCAGGACAGACAGCCAGGATCACCTGCTCTGG

AAATAAATTGGGGGATAAATATGTTGCCTGGTATCAGCAGAAGCCAGGCCAGTCCCCTATGTTGGTCATCT

ATCAAGATACTAAGCGCCCCTCAAGAGTTTCTGAGCGATTCTCTGGCTCCAACTCTGCGAATACAGCCACT

CTGTCCATCAGCGGGACCCAGGCTCTGGATGAGGCTGACTATTACTGTCAGGCGTGGGACAGCAGCATTGT

GATCTTCGGCGGAGGGACCAGGCTGACCGTCCTA

559A-M0145-D11 LV
CAGAGCGTCTTGACTCAGCCACCCTCAGTGTCCGTGTCTCCAGGACAGACAGCCAGCATCACCTGCTCTGG

AGATAAATTGGGGGATAAATATACTTCCTGGTATCAGCAGAGGCCAGGCCAGTCCCCTGTATTGGTCATCT

ATCAAGATATCAAGCGGCCCTCAGGGATCCCTGAGCGATTCTCTGGCTCCAACTCTGGGAACACAGCCACT

CTGACCATCAGCGGGACCCAGGCTATGGATGAGGCTGACTATTACTGTCAGGCGTGGGACAGTCCCAATGC

GAGGGTCTTCGGATCTGGGACCAAGGTCACCGTCCTA

559A-M0162-A04 LV
GACATCCAGATGACCCAGTCTCCTTCCACCCTGTCTGCATCTGTAGGAGACAGAGTCACCATCACTTGCCG

GGCCAGTCAGAGTATCAGTAGTTGGTTGGCCTGGTATCAGCAGAAACCAGGGAAAGCCCCTAACCTCCTGA

TCTATAAGGCGTCTACTTTAGAAAGTGGGGTCCCATCAAGGTTCAGCGGCAGTGGATCTGGGACAGAATTC

ACTCTCACCATCAGCAGCCTGCAGCCTGATGATTTTGCAACTTATTACTGCCAACAGTATAATACTTATTG

GACGTTCGGCCAAGGGACCAAGGTGGAAATCAAA

559A-X0101-A01 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-A03 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-B07 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-D01 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-D05 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-E09 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-F02 LV
GACATCCAGATGACCCAGTCCCCCTCCACCCTGTCCGCCTCTGTGGGCGACAGAGTGACCATCACCTGTCG

```
GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-G04 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-H06 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-M0006-D09 LV
GACATCCAGATGACCCAGTCTCCATCCTCCCTGTCTGCATCTGTAGGAGACAGAGTCACCATCACTTGCCG

GGCAAGTCAGAGTATTCGCAACTATTTAAATTGGTATCAGCAGAAACCAGGGAAAGCCCCTAACCTCCTGA

TCTATGCTGCATCCACTTTGCAAAGTGGGGTCCCAGCAAGGTTCAGTGGCAGTGGATCTGGGACAGATTTC

ACTCTCACTATCAGCAGTCTGCAGCCTGAAGATTTTGCAACTTATTACTGTCAACAGCTTAGTGGTTACCC

CCACACTTTTGGCCAGGGGACCAAGCTGGAGATCAAA

559A-M0035-G04 LV
CAAGACATCCAGATGACCCAGTCTCCAGCCACCCTGTCTTTGTCTCCAGGGGAAAGAGCCACCCTCTCCTG

CAGGGCCAGTCAGAGTGTTAGCAGCTACTTAGCCTGGTACCAACAGAAACCTGGCCAGGCTCCCAGGCTCC

TCATCTATGATGCATCCAACAGGGCCACTGGCATCCCAGCCAGGTTCAGTGGCAGTGGGTCTGGGACAGAC

TTCACTCTCACCATCAGCAGCCTAGAGCCTGAAGATTTTGCAGTTTATTACTGTCAGCAGCGTAGCAACTG

GCCTCGCGGATTCACTTTCGGCCCTGGGACCAAAGTGGATATCAAA

559A-M0029-D09 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTGGTACACTATGGTTTGGGTTCGCCAAGCTCCTGGTAAAGGTTTGGAGTGGG

TTTCTTATATCTATCCTTCTGGTGGCGCTACTTTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGATGGGTTCATATGATTACATTTGGGGATTTTATAGTGACCACTGGGGCCAGGGAACCCTGGTCA

CCGTCTCAAGC

559A-M0145-D11 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTCATTACCGTATGTCTTGGGTTCGCCAAGCTCCTGGTAAAGGTTTGGAGTGGG

TTTCTTCTATCTATCCTTCTGGTGGCCGTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGAAAGATAAGTTCGAGTGGAGGTTATTATTTCGCGGGATTGGAAATGATGCTTTTGATATCTGGG

GCCAAGGGACAATGGTCACCGTCTCAAGC

559A-M0162-A04 HV
GAAGTTCAATTGTTAGAGTCTGGTGGCGGTCTTGTTCAGCCTGGTGGTTCTTTACGTCTTTCTTGCGCTGC
```

-continued

TTCCGGATTCACTTTCTCTCATTACATTATGATGTGGGTTCGCCAAGCTCCTGGTAAAGGTTTGGAGTGGG

TTTCTGGTATCTATTCTTCTGGTGGCATTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGTACCGCCGGACTGGGATTCCAAGAAGAGATGCTTTTGATATCTGGGGCCAAGGGACAATGGTCA

CCGTCTCAAGC

559A-X0101-A01 HV
GAGGTGCAATTGCTGGAATCCGGCGGAGGTCTGGTGCAGCCTGGCGGCTCCCTGAGACTGTCTTGCGCCGC

CTCCGGCTTCACCTTCTCCCACTACCTGATGACCTGGGTGCGCCAGGCTCCTGGCAAGGGCCTCGAATGGG

TGTCCTACATCTCCCCCTCTGGCGGCCACACCATCTACGCCGACTCCGTGAAGGGCCGGTTCACCATCTCC

CGGGACAACTCCAAGAACACCCTGTATCTGCAGATGAACTCCCTGAGGGCCGAGGACACCGCCGTGTACTA

CTGCGCCAGGGTGGCCAGAGGAATCGCCGCCAGGTCCCGGACCTCCTACTTCGACTACTGGGGCCAGGGCA

CCCTGGTGACCGTGTCCTCC

559A-X0115-A03 HV
GAGGTGCAATTGCTGGAATCCGGCGGAGGACTGGTGCAGCCTGGCGGCTCCCTGAGACTGTCTTGCGCCGC

CTCCGGCTTTACCTTCTCCCACTACATCATGATGTGGGTGCGACAGGCTCCAGGCAAGGGCCTGGAATGGG

TGTCCGGCATCTACTCCTCCGGCGGCATCACCGTGTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGTGCCTGGCGGAGAATCGGCGTGCCCAGACGGGACTCCTTCGACATGTGGGGACAGGGCACCATGGTGA

CAGTGTCCTCC

559A-X0115-B07 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

CTGTGCCATGGTCGGCCAGGGAATCCGGGGCAGATCCCGGACCTCCTACTTCGCCCAGTGGGGCCAGGGCA

CCCTGGTGACAGTGTCCTCT

559A-X0115-D01 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCATCTACTCCATGCACTGGGTGCGACAGGCTCCAGGCAAGGGCCTGGAATGGG

TGTCCTCCATCTACCCCTCCCGGGGCATGACTTGGTACGCCGACTCCGTGAAGGGCCGGTTCACAATCTCC

CGGGACAACTCCAAGAACACCCTGTACCTGCAGATGAACTCCCTGCGGGCCGAGGACACCGCCGTGTACTA

CTGCGCCTACCGGCGGACCGGCATCCCTAGACGGGACGCCTTCGACATCTGGGGCAGGGCACCATGGTGA

CAGTGTCCTCC

559A-X0115-D05 HV
GAGGTGCAATTGCTGGAATCCGGCGGTGGACTGGTGCAGCCTGGCGGCTCCCTGAGACTGTCTTGCGCCGC

CTCCGGCTTCACCTTCTCCGACTACATGATGGCCTGGGTGCGACAGGCCCCTGGCAAGGGACTGGAATGGG

TGTCCTCCATCGTGCCCTCTGGCGGCCACACCCACTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGCGCCAGAGTGGCCAGAGGAATCGCCGCCAGATCCCGGACCTCCTACTTCGACTACTGGGGCCAGGGCA

CCCTGGTGACAGTGTCCTCC

559A-X0115-E09 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

CTGTGCCCGGGTGGCCCAGGGAATCGCCGCCAGATCCCGGACCTCCTCTGTGGATCAGTGGGGCCAGGGCA

CCCTGGTGACAGTGTCCTCT

559A-X0115-F02 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACATCATGATGTGGGTGCGACAGGCTCCTGGCAAGGGGCTGGAATGGG

TGTCCGGCATCTACTCCTCCGGCGGCATCACCGTGTACGCCGACTCCGTGAAGGGCCGGTTCACCATCTCT

CGGGACAACTCCAAGAACACCCTGTACCTGCAGATGAACTCCCTGCGGGCCGAGGACACCGCCGTGTACTA

CTGCGCCTACCGGCGGATCGGCGTGCCCAGACGGGACGAGTTCGACATCTGGGGCAGGGCACCATGGTGA

CAGTGTCCTCC

559A-X0115-G04 HV
GAGGTGCAATTGCTGGAATCCGGCGGAGGACTGGTGCAGCCTGGCGGCTCCCTGAGACTGTCTTGCGCCGC

CTCCGGCTTCACCTTCTCTCACTACATTATGATGTGGGTGCGACAGGCTCCTGGCAAAGGCCTGGAATGGG

TGTCCGGCATCTACTCCTCCGGCGGCATCACCGTGTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGCGCCTACAGACGGACCGGCGTGCCCAGACGGGACGAGTTCGATATCTGGGGCAGGGCACCATGGTGA

CAGTGTCCTCC

559A-X0115-H06 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

CTGTGCCCGGGTGGCCCAGGGAATCTCCGCCAGATCCCGGACCTCCTACTTCGATTACTGGGGCCAGGGCA

CCCTGGTGACAGTGTCCTCT

559A-M0006-D09 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTTTTACTATATGGTTTGGGTTCGCCAAGCTCCTGGTAAAGGTTTGGAGTGGG

TTTCTGTTATCTATCCTTCTGGTGGCATTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGAGAGATAAATGGGCGGTGATGCCCCCCTACTACTACTACGCTATGGACGTCTGGGGCCAAGGGA

CCACGGTCACCGTCTCAAGC

559A-M0035-G04 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTATTACCATATGTCTTGGGTTCGCCAAGCTCCTGGTAAAGGTTTGGAGTGGG

TTTCTGTTATCTCTCCTTCTGGTGGCTCTACTAAGTATGCTGACTCCGTTAAAGGTCGCTTCACTATCTCT

AGAGACAACTCTAAGAATACTCTCTACTTGCAGATGAACAGCTTAAGGGCTGAGGACACTGCAGTCTACTA

TTGTGCGAGAGGCGGTTCGAGCGATTACGCTTGGGGGAGTTATCGTCGACCCTACTACTTTGACTACTGGG

GCCAGGGAACCCTGGTCACCGTCTCAAGC

SEQUENCE LISTING (2006 sequences)

SEQ ID NO: 1 - protein, 620 aa, Artificial Sequence
  Synthetic polypeptide
  misc_feature (372)..(372): Xaa can be any amino acid
GCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRXIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 2 - protein, 638 aa, Artificial Sequence
  Synthetic polypeptide
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 3 - DNA, 2252 bp, Artificial Sequence
  Synthetic polynucleotide
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 4 - protein, 638 aa, Artificial Sequence
  Synthetic polypeptide
MILFNRVGYFVSLFATVSCGCMTQLYKNTFFRGGDLAAIYTPDAQYCQKMCTFHPRCLLFSFLAVTPPKETNKRFGCFMKESITGTLPRIHRTGAISGHSLKQCGHQISACHRDIYKGLDMRGSNFNISKTDNIEECQKLCTNNFHCQFFTYATSAFYRPEYRKKCLLKHSASGTPTSIKSADNLVSGFSLKSCALSEIGCPMDIFQHSAFADLNVSQVITPDAFVCRTICTFHPNCLFFTFYTNEWETESQRNVCFLKTSKSGRPSPPIPQENAISGYSLLTCRKTRPEPCHSKIYSGVDFEGEELNVTFVQGADVCQETCTKTIRCQFFIYSLLPQDCKEEGCKCSLRLSTDGSPTRITYGMQGSSGYSLRLCKLVDSPDCTTKINARIVGGTNASLGEWPWQVSLQVKLVSQTHLCGGSIIGRQWVLTAAHCFDGIPYPDVWRIYGGILSLSEITKETPSSRIKELIIHQEYKVSEGNYDIALIKLQTPLNYTEFQKPICLPSKADTNTIYTNCWVTGWGYTKEQGETQNILQKATIPLVPNEECQKKYRDYVINKQMICAGYKEGGTDACKGDSGGPLVCKHSGRWQLVGITSWGEGCGRKDQPGVYTKVSEYMDWILEKTQSSDVRALETSSA

SEQ ID NO: 5 - DNA, 2472 bp, Artificial Sequence
  Synthetic polynucleotide
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 6 - protein, 638 aa, Artificial Sequence
  Synthetic polypeptide
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSHVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 7 - DNA, 2513 bp, Artificial Sequence
  Synthetic polynucleotide
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 8 - protein, 11 aa, Artificial Sequence
  Synthetic polypeptide
RASQSIRNYLN

SEQ ID NO: 9 - protein, 14 aa, Artificial Sequence
  Synthetic polypeptide
TGTNSDVGNYNLVS

SEQ ID NO: 10 - protein, 11 aa, Artificial Sequence
  Synthetic polypeptide
SGDKLGDKYAC

SEQ ID NO: 11 - protein, 11 aa, Artificial Sequence
  Synthetic polypeptide
SGDKLGNKYAY

SEQ ID NO: 12 - protein, 11 aa, Artificial Sequence
  Synthetic polypeptide
RASQSISVYLN

SEQ ID NO: 13 - protein, 12 aa, Artificial Sequence
  Synthetic polypeptide
RASQSVSSSYLA

SEQ ID NO: 14 - protein, 11 aa, Artificial Sequence
  Synthetic polypeptide
SGDQLGDKYVG

SEQ ID NO: 15 - protein, 11 aa, Artificial Sequence
  Synthetic polypeptide
SGDKLGDKYAC

SEQ ID NO: 16 - protein, 11 aa, Artificial Sequence
  Synthetic polypeptide
SGDQLGDKYVG

SEQ ID NO: 17 - protein, 11 aa, Artificial Sequence
  Synthetic polypeptide
SGNKLGDKYVA

SEQ ID NO: 18 - protein, 11 aa, Artificial Sequence
  Synthetic polypeptide
SGDNLGNKYNS

SEQ ID NO: 19 - protein, 11 aa, Artificial Sequence
  Synthetic polypeptide
RASQSVSSYLA

SEQ ID NO: 20 - protein, 11 aa, Artificial Sequence
  Synthetic polypeptide
SGEKLGDKYVS

SEQ ID NO: 21 - protein, 11 aa, Artificial Sequence
  Synthetic polypeptide
SGDKLGDKYTS

SEQ ID NO: 22 - protein, 13 aa, Artificial Sequence
  Synthetic polypeptide
SGSSSNIGSNTVS

SEQ ID NO: 23 - protein, 15 aa, Artificial Sequence
  Synthetic polypeptide
RSSQSLSDDGNTYLD

SEQ ID NO: 24 - protein, 16 aa, Artificial Sequence
  Synthetic polypeptide
RSSLSLLHSNGYNYLD

SEQ ID NO: 25 - protein, 13 aa, Artificial Sequence
  Synthetic polypeptide
SGNNSNFGSNTVT

SEQ ID NO: 26 - protein, 11 aa, Artificial Sequence
  Synthetic polypeptide
RASQPIDNYLN

SEQ ID NO: 27 - protein, 11 aa, Artificial Sequence
  Synthetic polypeptide
RASQSVSSYLA

SEQ ID NO: 28 - protein, 11 aa, Artificial Sequence
  Synthetic polypeptide
SGDKLGDKYTS

SEQ ID NO: 29 - protein, 11 aa, Artificial Sequence
  Synthetic polypeptide
RASGDIGNALG

SEQ ID NO: 30 - protein, 11 aa, Artificial Sequence
  Synthetic polypeptide
RASQSISSYLS

SEQ ID NO: 31 - protein, 11 aa, Artificial Sequence
  Synthetic polypeptide
RASQGISSYLA

SEQ ID NO: 32 - protein, 11 aa, Artificial Sequence
  Synthetic polypeptide
SGDKLGDKYVS

SEQ ID NO: 33 - protein, 11 aa, Artificial Sequence
  Synthetic polypeptide
RASQSISSWLA

SEQ ID NO: 34 - protein, 11 aa, Artificial Sequence
  Synthetic polypeptide
RASQPIDNYLN

SEQ ID NO: 35 - protein, 11 aa, Artificial Sequence
  Synthetic polypeptide
RASQPIDNYLN

SEQ ID NO: 36 - protein, 11 aa, Artificial Sequence
  Synthetic polypeptide
RASQPIDNYLN

SEQ ID NO: 37 - protein, 11 aa, Artificial Sequence
  Synthetic polypeptide
RASQPIDNYLN

SEQ ID NO: 38 - protein, 11 aa, Artificial Sequence
  Synthetic polypeptide
RASQPIDNYLN

SEQ ID NO: 39 - protein, 11 aa, Artificial Sequence
  Synthetic polypeptide
RASQPIDNYLN

SEQ ID NO: 40 - protein, 11 aa, Artificial Sequence
  Synthetic polypeptide
RASQPIDNYLN

SEQ ID NO: 41 - protein, 11 aa, Artificial Sequence
  Synthetic polypeptide
RASQPIDNYLN

SEQ ID NO: 42 - protein, 11 aa, Artificial Sequence
  Synthetic polypeptide
RASQPIDNYLN

SEQ ID NO: 43 - protein, 12 aa, Artificial Sequence
  Synthetic polypeptide
RTSQFVNSNYLA

SEQ ID NO: 44 - protein, 7 aa, Artificial Sequence
  Synthetic polypeptide
AASTLQS

SEQ ID NO: 45 - protein, 7 aa, Artificial Sequence
  Synthetic polypeptide
EVNKRPS

SEQ ID NO: 46 - protein, 7 aa, Artificial Sequence
  Synthetic polypeptide
QDSKRPS

SEQ ID NO: 47 - protein, 7 aa, Artificial Sequence
  Synthetic polypeptide
QDNNRPS

SEQ ID NO: 48 - protein, 7 aa, Artificial Sequence
  Synthetic polypeptide
GASNLQF

SEQ ID NO: 49 - protein, 7 aa, Artificial Sequence
  Synthetic polypeptide
GASSRAT

SEQ ID NO: 50 - protein, 7 aa, Artificial Sequence
  Synthetic polypeptide
QDTKRPS

SEQ ID NO: 51 - protein, 7 aa, Artificial Sequence
  Synthetic polypeptide
QDSKRPS

SEQ ID NO: 52 - protein, 7 aa, Artificial Sequence
  Synthetic polypeptide
QDTKRPS

SEQ ID NO: 53 - protein, 7 aa, Artificial Sequence
  Synthetic polypeptide
QDTKRPS

SEQ ID NO: 54 - protein, 7 aa, Artificial Sequence
  Synthetic polypeptide
QDTKRPS

SEQ ID NO: 55 - protein, 7 aa, Artificial Sequence
  Synthetic polypeptide
DASNRAT

SEQ ID NO: 56 - protein, 7 aa, Artificial Sequence
  Synthetic polypeptide
EDSRRPS

SEQ ID NO: 57 - protein, 7 aa, Artificial Sequence
  Synthetic polypeptide
QDIKRPS

SEQ ID NO: 58 - protein, 7 aa, Artificial Sequence
  Synthetic polypeptide
NDHRRPS

SEQ ID NO: 59 - protein, 7 aa, Artificial Sequence
  Synthetic polypeptide
TLSYRAS

SEQ ID NO: 60 - protein, 7 aa, Artificial Sequence
  Synthetic polypeptide
LSSTRAS

SEQ ID NO: 61 - protein, 7 aa, Artificial Sequence
  Synthetic polypeptide
SDSRRPS

SEQ ID NO: 62 - protein, 7 aa, Artificial Sequence
  Synthetic polypeptide
AASRLQS

SEQ ID NO: 63 - protein, 7 aa, Artificial Sequence
  Synthetic polypeptide
DASNRAT

SEQ ID NO: 64 - protein, 7 aa, Artificial Sequence
  Synthetic polypeptide
QDIKRPS

SEQ ID NO: 65 - protein, 7 aa, Artificial Sequence
  Synthetic polypeptide
DASTLQS

SEQ ID NO: 66 - protein, 7 aa, Artificial Sequence
  Synthetic polypeptide
AASSLQS

SEQ ID NO: 67 - protein, 7 aa, Artificial Sequence
  Synthetic polypeptide
AASTLQS

SEQ ID NO: 68 - protein, 7 aa, Artificial Sequence
  Synthetic polypeptide
QDTKRPS

SEQ ID NO: 69 - protein, 7 aa, Artificial Sequence
  Synthetic polypeptide
KASTLES

SEQ ID NO: 70 - protein, 7 aa, Artificial Sequence
  Synthetic polypeptide
AASRLQS

SEQ ID NO: 71 - protein, 7 aa, Artificial Sequence
  Synthetic polypeptide
AASRLQS

SEQ ID NO: 72 - protein, 7 aa, Artificial Sequence
  Synthetic polypeptide
AASRLQS

SEQ ID NO: 73 - protein, 7 aa, Artificial Sequence
  Synthetic polypeptide
AASRLQS

SEQ ID NO: 74 - protein, 7 aa, Artificial Sequence
  Synthetic polypeptide
AASRLQS

SEQ ID NO: 75 - protein, 7 aa, Artificial Sequence
  Synthetic polypeptide
AASRLQS

SEQ ID NO: 76 - protein, 7 aa, Artificial Sequence
  Synthetic polypeptide
AASRLQS

SEQ ID NO: 77 - protein, 7 aa, Artificial Sequence
  Synthetic polypeptide
AASRLQS

SEQ ID NO: 78 - protein, 7 aa, Artificial Sequence
  Synthetic polypeptide
AASRLQS

SEQ ID NO: 79 - protein, 7 aa, Artificial Sequence
  Synthetic polypeptide
GASSRAT

SEQ ID NO: 80 - protein, 9 aa, Artificial Sequence
  Synthetic polypeptide
QQLSGYPHT

SEQ ID NO: 81 - protein, 11 aa, Artificial Sequence
  Synthetic polypeptide
CSYAGNRNFYV

SEQ ID NO: 82 - protein, 9 aa, Artificial Sequence
  Synthetic polypeptide
QAWDSSTGV

SEQ ID NO: 83 - protein, 9 aa, Artificial Sequence
  Synthetic polypeptide
QAWDSRTVV

SEQ ID NO: 84 - protein, 8 aa, Artificial Sequence
  Synthetic polypeptide
QQTFSLFT

SEQ ID NO: 85 - protein, 9 aa, Artificial Sequence
  Synthetic polypeptide
QQYGSSPFT

SEQ ID NO: 86 - protein, 9 aa, Artificial Sequence
  Synthetic polypeptide
QAWDTSTAG

SEQ ID NO: 87 - protein, 9 aa, Artificial Sequence
  Synthetic polypeptide
QAWDSSTGV

SEQ ID NO: 88 - protein, 9 aa, Artificial Sequence
  Synthetic polypeptide
QAWDTSTAG

SEQ ID NO: 89 - protein, 9 aa, Artificial Sequence
  Synthetic polypeptide
QAWDSSIVI

SEQ ID NO: 90 - protein, 8 aa, Artificial Sequence
  Synthetic polypeptide
QAWDGNVV

SEQ ID NO: 91 - protein, 11 aa, Artificial Sequence
  Synthetic polypeptide
QQRSNWPRGFT

SEQ ID NO: 92 - protein, 9 aa, Artificial Sequence
  Synthetic polypeptide
QAWDSSTAI

SEQ ID NO: 93 - protein, 10 aa, Artificial Sequence
  Synthetic polypeptide
QAWDSPNARV

SEQ ID NO: 94 - protein, 11 aa, Artificial Sequence
  Synthetic polypeptide
SAWDDSLNGVV

SEQ ID NO: 95 - protein, 9 aa, Artificial Sequence
  Synthetic polypeptide
MQGTHWPPT

SEQ ID NO: 96 - protein, 9 aa, Artificial Sequence
  Synthetic polypeptide
MQPLETPPT

SEQ ID NO: 97 - protein, 10 aa, Artificial Sequence
  Synthetic polypeptide
AAWDDSLNGV

SEQ ID NO: 98 - protein, 9 aa, Artificial Sequence
  Synthetic polypeptide
QQSYTVPYT

SEQ ID NO: 99 - protein, 11 aa, Artificial Sequence
  Synthetic polypeptide
QQRSNWPRGFT

SEQ ID NO: 100 - protein, 10 aa, Artificial Sequence
  Synthetic polypeptide
QAWDSPNARV

SEQ ID NO: 101 - protein, 9 aa, Artificial Sequence
  Synthetic polypeptide
LQGYNYPRT

SEQ ID NO: 102 - protein, 9 aa, Artificial Sequence
  Synthetic polypeptide
QQSISIPRT

SEQ ID NO: 103 - protein, 9 aa, Artificial Sequence
  Synthetic polypeptide
QQLNSYPLT

SEQ ID NO: 104 - protein, 9 aa, Artificial Sequence
  Synthetic polypeptide
QAWDSSTYV

SEQ ID NO: 105 - protein, 8 aa, Artificial Sequence
  Synthetic polypeptide
QQYNTYWT

SEQ ID NO: 106 - protein, 9 aa, Artificial Sequence
  Synthetic polypeptide
QQSYTVPYT

SEQ ID NO: 107 - protein, 9 aa, Artificial Sequence
  Synthetic polypeptide
QQSYTVPYT

SEQ ID NO: 108 - protein, 9 aa, Artificial Sequence
  Synthetic polypeptide
QQSYTVPYT

SEQ ID NO: 109 - protein, 9 aa, Artificial Sequence
  Synthetic polypeptide
QQSYTVPYT

SEQ ID NO: 110 - protein, 9 aa, Artificial Sequence
  Synthetic polypeptide
QQSYTVPYT

SEQ ID NO: 111 - protein, 9 aa, Artificial Sequence
  Synthetic polypeptide
QQSYTVPYT

SEQ ID NO: 112 - protein, 9 aa, Artificial Sequence
  Synthetic polypeptide
QQSYTVPYT

SEQ ID NO: 113 - protein, 9 aa, Artificial Sequence
  Synthetic polypeptide
QQSYTVPYT

SEQ ID NO: 114 - protein, 9 aa, Artificial Sequence
  Synthetic polypeptide
QQSYTVPYT

SEQ ID NO: 115 - protein, 9 aa, Artificial Sequence
  Synthetic polypeptide
QQSSRTPWT

SEQ ID NO: 116 - protein, 5 aa, Artificial Sequence
  Synthetic polypeptide
FYYMV

SEQ ID NO: 117 - protein, 5 aa, Artificial Sequence
  Synthetic polypeptide
WYSMV

SEQ ID NO: 118 - protein, 5 aa, Artificial Sequence
  Synthetic polypeptide
WYLMI

SEQ ID NO: 119 - protein, 5 aa, Artificial Sequence
  Synthetic polypeptide
TYFML

SEQ ID NO: 120 - protein, 5 aa, Artificial Sequence
  Synthetic polypeptide
FYNMN

SEQ ID NO: 121 - protein, 5 aa, Artificial Sequence
  Synthetic polypeptide
PYNMY

SEQ ID NO: 122 - protein, 5 aa, Artificial Sequence
  Synthetic polypeptide
WYTMV

SEQ ID NO: 123 - protein, 5 aa, Artificial Sequence
  Synthetic polypeptide
WYLMI

SEQ ID NO: 124 - protein, 5 aa, Artificial Sequence
  Synthetic polypeptide
WYTMV

SEQ ID NO: 125 - protein, 5 aa, Artificial Sequence
  Synthetic polypeptide
WYTMV

SEQ ID NO: 126 - protein, 5 aa, Artificial Sequence
  Synthetic polypeptide
WYEMG

SEQ ID NO: 127 - protein, 5 aa, Artificial Sequence
  Synthetic polypeptide
YYHMS

SEQ ID NO: 128 - protein, 5 aa, Artificial Sequence
  Synthetic polypeptide
YYMMV

SEQ ID NO: 129 - protein, 5 aa, Artificial Sequence
  Synthetic polypeptide
HYRMS

SEQ ID NO: 130 - protein, 5 aa, Artificial Sequence
  Synthetic polypeptide
RYEMY

SEQ ID NO: 131 - protein, 5 aa, Artificial Sequence
  Synthetic polypeptide
FYAMH

SEQ ID NO: 132 - protein, 5 aa, Artificial Sequence
  Synthetic polypeptide
YYEMD

SEQ ID NO: 133 - protein, 5 aa, Artificial Sequence
  Synthetic polypeptide
DYRMQ

SEQ ID NO: 134 - protein, 5 aa, Artificial Sequence
  Synthetic polypeptide
AYSMI

SEQ ID NO: 135 - protein, 5 aa, Artificial Sequence
  Synthetic polypeptide
YYHMS

SEQ ID NO: 136 - protein, 5 aa, Artificial Sequence
  Synthetic polypeptide
HYRMS

SEQ ID NO: 137 - protein, 5 aa, Artificial Sequence
  Synthetic polypeptide
RYIMH

SEQ ID NO: 138 - protein, 5 aa, Artificial Sequence
  Synthetic polypeptide
PYFMG

SEQ ID NO: 139 - protein, 5 aa, Artificial Sequence
  Synthetic polypeptide
HYLMT

SEQ ID NO: 140 - protein, 5 aa, Artificial Sequence
  Synthetic polypeptide
DYAMK

SEQ ID NO: 141 - protein, 5 aa, Artificial Sequence
  Synthetic polypeptide
HYIMM

SEQ ID NO: 142 - protein, 5 aa, Artificial Sequence
  Synthetic polypeptide
AYSMI

SEQ ID NO: 143 - protein, 5 aa, Artificial Sequence
  Synthetic polypeptide
AYSMI

SEQ ID NO: 144 - protein, 5 aa, Artificial Sequence
  Synthetic polypeptide
AYSMI

SEQ ID NO: 145 - protein, 5 aa, Artificial Sequence
  Synthetic polypeptide
AYSMI

SEQ ID NO: 146 - protein, 5 aa, Artificial Sequence
  Synthetic polypeptide
AYSMI

SEQ ID NO: 147 - protein, 5 aa, Artificial Sequence
  Synthetic polypeptide
AYSMI

SEQ ID NO: 148 - protein, 5 aa, Artificial Sequence
  Synthetic polypeptide
AYSMI

SEQ ID NO: 149 - protein, 5 aa, Artificial Sequence
  Synthetic polypeptide
AYSMI

SEQ ID NO: 150 - protein, 5 aa, Artificial Sequence
  Synthetic polypeptide
AYSMI

SEQ ID NO: 151 - protein, 5 aa, Artificial Sequence
  Synthetic polypeptide
HYLMT

SEQ ID NO: 152 - protein, 17 aa, Artificial Sequence
  Synthetic polypeptide
VIYPSGGITVYADSVKG

SEQ ID NO: 153 - protein, 17 aa, Artificial Sequence
  Synthetic polypeptide
SISPSGGLTNYADSVKG

SEQ ID NO: 154 - protein, 17 aa, Artificial Sequence
  Synthetic polypeptide
YIYPSGGFTYYADSVKG

SEQ ID NO: 155 - protein, 17 aa, Artificial Sequence
  Synthetic polypeptide
SIYPSGGNTVYADSVKG

SEQ ID NO: 156 - protein, 17 aa, Artificial Sequence
  Synthetic polypeptide
SISPSGGETNYADSVKG

SEQ ID NO: 157 - protein, 17 aa, Artificial Sequence
  Synthetic polypeptide
SIRPSGGGTVYADSVKG

SEQ ID NO: 158 - protein, 17 aa, Artificial Sequence
  Synthetic polypeptide
RIYPSGGWTKYADSVKG

SEQ ID NO: 159 - protein, 17 aa, Artificial Sequence
  Synthetic polypeptide
YIYPSGGFTYYADSVKG

SEQ ID NO: 160 - protein, 17 aa, Artificial Sequence
  Synthetic polypeptide
RIYPSGGWTKYADSVKG

SEQ ID NO: 161 - protein, 17 aa, Artificial Sequence
  Synthetic polypeptide
YIYPSGGATFYADSVKG

SEQ ID NO: 162 - protein, 17 aa, Artificial Sequence
  Synthetic polypeptide
SIYSSGGGTMYADSVKG

SEQ ID NO: 163 - protein, 17 aa, Artificial Sequence
  Synthetic polypeptide
VISPSGGSTKYADSVKG

SEQ ID NO: 164 - protein, 17 aa, Artificial Sequence
  Synthetic polypeptide
YIYSSGGHTVYADSVKG

SEQ ID NO: 165 - protein, 17 aa, Artificial Sequence
  Synthetic polypeptide
SIYPSGGRTVYADSVKG

SEQ ID NO: 166 - protein, 17 aa, Artificial Sequence
  Synthetic polypeptide
SISSSGGPTAYADSVKG

SEQ ID NO: 167 - protein, 17 aa, Artificial Sequence
  Synthetic polypeptide
GIVPSGGRTHYADSVKG

SEQ ID NO: 168 - protein, 17 aa, Artificial Sequence
  Synthetic polypeptide
GISSSGGHTAYADSVKG

SEQ ID NO: 169 - protein, 17 aa, Artificial Sequence
  Synthetic polypeptide
VIVPSGGNTMYADSVKG

SEQ ID NO: 170 - protein, 17 aa, Artificial Sequence
  Synthetic polypeptide
YIRPSGGRTTYADSVKG

SEQ ID NO: 171 - protein, 17 aa, Artificial Sequence
  Synthetic polypeptide
VISPSGGSTKYADSVKG

SEQ ID NO: 172 - protein, 17 aa, Artificial Sequence
  Synthetic polypeptide
SIYPSGGRTVYADSVKG

SEQ ID NO: 173 - protein, 17 aa, Artificial Sequence
  Synthetic polypeptide
SISPSGGLTSYADSVKG

SEQ ID NO: 174 - protein, 17 aa, Artificial Sequence
  Synthetic polypeptide
GIGPSGGSTTYADSVKG

SEQ ID NO: 175 - protein, 17 aa, Artificial Sequence
  Synthetic polypeptide
YISPSGGHTIYADSVKG

SEQ ID NO: 176 - protein, 17 aa, Artificial Sequence
  Synthetic polypeptide
SISSSGGVTQYADSVKG

SEQ ID NO: 177 - protein, 17 aa, Artificial Sequence
  Synthetic polypeptide
GIYSSGGITVYADSVKG

SEQ ID NO: 178 - protein, 17 aa, Artificial Sequence
  Synthetic polypeptide
YIRPSGGRTTYADSVKG

SEQ ID NO: 179 - protein, 17 aa, Artificial Sequence
  Synthetic polypeptide
YIRPSGGRTTYADSVKG

SEQ ID NO: 180 - protein, 17 aa, Artificial Sequence
  Synthetic polypeptide
YIRPSGGRTTYADSVKG

SEQ ID NO: 181 - protein, 17 aa, Artificial Sequence
  Synthetic polypeptide
YIRPSGGRTTYADSVKG

SEQ ID NO: 182 - protein, 17 aa, Artificial Sequence
  Synthetic polypeptide
YIRPSGGRTTYADSVKG

SEQ ID NO: 183 - protein, 17 aa, Artificial Sequence
  Synthetic polypeptide
YIRPSGGRTTYADSVKG

SEQ ID NO: 184 - protein, 17 aa, Artificial Sequence
  Synthetic polypeptide
YIRPSGGRTTYADSVKG

SEQ ID NO: 185 - protein, 17 aa, Artificial Sequence
  Synthetic polypeptide
YIRPSGGRTTYADSVKG

SEQ ID NO: 186 - protein, 17 aa, Artificial Sequence
  Synthetic polypeptide
YIRPSGGRTTYADSVKG

SEQ ID NO: 187 - protein, 17 aa, Artificial Sequence
  Synthetic polypeptide
YISPSGGHTIYADSVKG

SEQ ID NO: 188 - protein, 16 aa, Artificial Sequence
  Synthetic polypeptide
DKWAVMPPYYYYAMDV

SEQ ID NO: 189 - protein, 14 aa, Artificial Sequence
  Synthetic polypeptide
HTAARPFYYYYMDV

SEQ ID NO: 190 - protein, 13 aa, Artificial Sequence
  Synthetic polypeptide
TEGPLSWGYGMDV

SEQ ID NO: 191 - protein, 15 aa, Artificial Sequence
  Synthetic polypeptide
AASPVRNYYYYGMDV

SEQ ID NO: 192 - protein, 15 aa, Artificial Sequence
  Synthetic polypeptide
GGGAYRNNWWGGFDI

SEQ ID NO: 193 - protein, 12 aa, Artificial Sequence
  Synthetic polypeptide
GFIAARWYYFDY

SEQ ID NO: 194 - protein, 13 aa, Artificial Sequence
  Synthetic polypeptide
EGLLWFGENAFDI

SEQ ID NO: 195 - protein, 13 aa, Artificial Sequence
  Synthetic polypeptide
TEGPLSWGYGMDV

SEQ ID NO: 196 - protein, 13 aa, Artificial Sequence
  Synthetic polypeptide
EGLLWFGENAFDI

SEQ ID NO: 197 - protein, 13 aa, Artificial Sequence
  Synthetic polypeptide
GSYDYIWGFYSDH

SEQ ID NO: 198 - protein, 18 aa, Artificial Sequence
  Synthetic polypeptide
NPQYSGYDRSLSDGAFDI

SEQ ID NO: 199 - protein, 19 aa, Artificial Sequence
  Synthetic polypeptide
GGSSDYAWGSYRRPYYFDY

SEQ ID NO: 200 - protein, 15 aa, Artificial Sequence
  Synthetic polypeptide
DLFLYDFWSKGAFDI

SEQ ID NO: 201 - protein, 19 aa, Artificial Sequence
  Synthetic polypeptide
DKFEWRLLFRGIGNDAFDI

SEQ ID NO: 202 - protein, 20 aa, Artificial Sequence
  Synthetic polypeptide
GTPKWELLLRSIYIENAFDI

SEQ ID NO: 203 - protein, 12 aa, Artificial Sequence
  Synthetic polypeptide
DSSGSPNPLFDY

SEQ ID NO: 204 - protein, 16 aa, Artificial Sequence
  Synthetic polypeptide
ERRSSSRARYYYGMDV

SEQ ID NO: 205 - protein, 21 aa, Artificial Sequence
  Synthetic polypeptide
GGPGSSIAARRAPTGYYGMDV

SEQ ID NO: 206 - protein, 17 aa, Artificial Sequence
  Synthetic polypeptide
GGLLLWFRELKSNYFDY

SEQ ID NO: 207 - protein, 19 aa, Artificial Sequence
  Synthetic polypeptide
GGSSDYAWGSYRRPYYFDY

SEQ ID NO: 208 - protein, 19 aa, Artificial Sequence
  Synthetic polypeptide
DKFEWRLLFRGIGNDAFDI

SEQ ID NO: 209 - protein, 15 aa, Artificial Sequence
  Synthetic polypeptide
EFENAYHYYYYGMDV

SEQ ID NO: 210 - protein, 20 aa, Artificial Sequence
  Synthetic polypeptide
EGPPYSSGWYRGLRQYHFDY

SEQ ID NO: 211 - protein, 16 aa, Artificial Sequence
  Synthetic polypeptide
VARGIAARSRTSYFDY

SEQ ID NO: 212 - protein, 21 aa, Artificial Sequence
  Synthetic polypeptide
EEDYSSSWYSRRFDYYYGMDV

SEQ ID NO: 213 - protein, 13 aa, Artificial Sequence
  Synthetic polypeptide
RRTGIPRRDAFDI

SEQ ID NO: 214 - protein, 17 aa, Artificial Sequence
  Synthetic polypeptide
GGLLLWSRELKSNYFDY

SEQ ID NO: 215 - protein, 17 aa, Artificial Sequence
  Synthetic polypeptide
GGLLLWFMELKSNYFDY

SEQ ID NO: 216 - protein, 17 aa, Artificial Sequence
  Synthetic polypeptide
GGLLLWGRELKSNYFDY

SEQ ID NO: 217 - protein, 17 aa, Artificial Sequence
  Synthetic polypeptide
GGLLLWNRELKSNYFDY

SEQ ID NO: 218 - protein, 17 aa, Artificial Sequence
  Synthetic polypeptide
GGLLLWDRELKSNYFDY

SEQ ID NO: 219 - protein, 17 aa, Artificial Sequence
  Synthetic polypeptide
GGLLLWQRELKSNYFDY

SEQ ID NO: 220 - protein, 17 aa, Artificial Sequence
  Synthetic polypeptide
GGLLLWTRELKSNYFDY

SEQ ID NO: 221 - protein, 17 aa, Artificial Sequence
  Synthetic polypeptide
GGLLLWARELKSNYFDY

SEQ ID NO: 222 - protein, 17 aa, Artificial Sequence
  Synthetic polypeptide
GGLLLWERELKSNYFDY

SEQ ID NO: 223 - protein, 16 aa, Artificial Sequence
  Synthetic polypeptide
VARGIAARSRTSYFDY

SEQ ID NO: 224 - protein, 108 aa, Artificial Sequence
  Synthetic polypeptide
QDIQMTQSPSSLSASVGDRVTITCRASQSIRNYLNWYQQKPGKAPNLLIYAASTLQSGVPARFSGSGSGTDFTLTISSLQPEDFATYYCQQLSGYPHTFGQGTKLEIK

SEQ ID NO: 225 - protein, 142 aa, Artificial Sequence
  Synthetic polypeptide
EVQLLESGGGLVQPGGSLRLSCAASGFTFSFYYMVWVRQAPGKGLEWVSVIYPSGGITVYADSVKGRFTISRDNSKNTLYLQMNSLRAEDTAVYYCARDKWAVMPPYYYYAMDVWGQGTTVTVSSASTKGPSVFPLAPSSKS

SEQ ID NO: 226 - protein, 111 aa, Artificial Sequence
  Synthetic polypeptide
QSALTQPASVSGSPGQSITISCTGTNSDVGNYNLVSWYQQHPGEAPKLLIYEVNKRPSGVSNRFSGSKSGNTASLTISGLQAEDEADYLCCSYAGNRNFYVFGAGTKVTVL

SEQ ID NO: 227 - protein, 140 aa, Artificial Sequence
  Synthetic polypeptide
EVQLLESGGGLVQPGGSLRLSCAASGFTFSWYSMVWVRQAPGKGLEWVSSISPSGGLTNYADSVKGRFTISRDNSKNTLYLQMNSLRAEDTAVYYCARHTAARPFYYYYMDVWGKGTTVTVSSASTKGPSVFPLAPSSKS

SEQ ID NO: 228 - protein, 106 aa, Artificial Sequence
  Synthetic polypeptide
QSELTQPPSVSVSPGQTASITCSGDKLGDKYACWYQQKPGQSPVLVIYQDSKRPSGIPERFSGSNSGNTATLTISGTQAMDEADYYCQAWDSSTGVFGGGTKLTVL

SEQ ID NO: 229 - protein, 139 aa, Artificial Sequence
  Synthetic polypeptide
EVQLLESGGGLVQPGGSLRLSCAASGFTFSWYLMIWVRQAPGKGLEWVSYIYPSGGFTYYADSVKGRFTISRDNSKNTLYLQMNSLRAEDMAVYYCARTEGPLSWGYGMDVWGQGTTVTVSSASTKGPSVFPLAPSSKS

SEQ ID NO: 230 - protein, 106 aa, Artificial Sequence
  Synthetic polypeptide
QCELTQPPSESVSPGQTANITCSGDKLGNKYAYWYQQKPGQSPVLVIYQDNNRPSGIPERFSGSNSGNTATLTISGTQAIDEANYYCQAWDSRTVVFGGGTKLTVL

SEQ ID NO: 231 - protein, 141 aa, Artificial Sequence
  Synthetic polypeptide
EVQLLESGGGLVQPGGSLRLSCAASGFTFSTYFMLWVRQAPGKGLEWVSSIYPSGGNTVYADSVKGRFTISRDNSKNTLYLQMNSLRAEDTAVYYCARAASPVRNYYYYGMDVWGQGTTVTVSSASTKGPSVFPLAPSSKS

SEQ ID NO: 232 - protein, 107 aa, Artificial Sequence
  Synthetic polypeptide
QDIQMTQSPSSLSASVGDRVTITCRASQSISVYLNWYQHKPGKAPKLLIYGASNLQFGVPSRFSGSGYGTDFTLTISSLQPEDFATYHCQQTFSLFTFGGGTKVEIK

SEQ ID NO: 233 - protein, 141 aa, Artificial Sequence
  Synthetic polypeptide
EVQLLESGGGLVQPGGSLRLSCAASGFTFSFYNMNWVRQAPGKGLEWVSSISPSGGETNYADSVKGRFTISRDNSKNTLYLQMNSLRAEDTAVYYCARGGGAYRNNWWGGFDIWGLGTMVTVSSASTKGPSVFPLAPSSKS

SEQ ID NO: 234 - protein, 109 aa, Artificial Sequence
  Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 235 - protein, 138 aa, Artificial Sequence
  Synthetic polypeptide
EVQLLESGGGLVQPGGSLRLSCAASGFTFSPYNMYWVRQAPGKGLEWVSSIRPSGGGTVYADSVKGRFTISRDNSKNTLYLQMNSLRAEDTAVYYCAGGFIAARWYYFDYWGQGTLVTVSSASTKGPSVFPLAPSSKS

SEQ ID NO: 236 - protein, 106 aa, Artificial Sequence
  Synthetic polypeptide
QSVLTQPPSVSVSPGQTATITCSGDQLGDKYVGWYQQKPGQSPILVIYQDTKRPSGIPERFSGSNSGNTATLTISGTHTVDEAHYYCQAWDTSTAGFGGGTKLTVL

SEQ ID NO: 237 - protein, 139 aa, Artificial Sequence
  Synthetic polypeptide
EVQLLESGGGLVQPGGSLRLSCAASGFTFSWYTMVWVRQAPGKGLEWVSRIYPSGGWTKYADSVKGRFTISRDNSKNTLYLQMNSLRAEDTATYYCAREGLLWFGENAFDIWGQGTMVTVSSASTKGPSVFPLAPSSKS

SEQ ID NO: 238 - protein, 106 aa, Artificial Sequence; identical to SEQ ID NO: 228
  Synthetic polypeptide

SEQ ID NO: 239 - protein, 139 aa, Artificial Sequence; identical to SEQ ID NO: 229
  Synthetic polypeptide

SEQ ID NO: 240 - protein, 106 aa, Artificial Sequence; identical to SEQ ID NO: 236
  Synthetic polypeptide

SEQ ID NO: 241 - protein, 139 aa, Artificial Sequence; identical to SEQ ID NO: 237
  Synthetic polypeptide

SEQ ID NO: 242 - protein, 106 aa, Artificial Sequence
  Synthetic polypeptide
QSALTQPPTVSVSPGQTARITCSGNKLGDKYVAWYQQKPGQSPMLVIYQDTKRPSRVSERFSGSNSANTATLSISGTQALDEADYYCQAWDSSIVIFGGGTRLTVL

SEQ ID NO: 243 - protein, 139 aa, Artificial Sequence
  Synthetic polypeptide
EVQLLESGGGLVQPGGSLRLSCAASGFTFSWYTMVWVRQAPGKGLEWVSYIYPSGGATFYADSVKGRFTISRDNSKNTLYLQMNSLRAEDTAVYYCAMGSYDYIWGFYSDHWGQGTLVTVSSASTKGPSVFPLAPSSKS

SEQ ID NO: 244 - protein, 105 aa, Artificial Sequence
  Synthetic polypeptide
QYELTQPPSVSVSPGQTATITCSGDNLGNKYNSWYQQKPGQSPLLVIYQDTKRPSAIPERFSGSNSGNTATLTISGTQAMDEADYYCQAWDGNVVFGGGTKLTVL

SEQ ID NO: 245 - protein, 144 aa, Artificial Sequence
  Synthetic polypeptide
EVQLLESGGGLVQPGGSLRLSCAASGFTFSWYEMGWVRQAPGKGLEWVSSIYSSGGGTMYADSVKGRFTISRDNSKNTLYLQMNSLRAEDTAVYYCARNPQYSGYDRSLSDGAFDIWGQGTMVTVSSASTKGPSVFPLAPSSKS

SEQ ID NO: 246 - protein, 110 aa, Artificial Sequence
  Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPRGFTFGPGTKVDIK

SEQ ID NO: 247 - protein, 145 aa, Artificial Sequence
  Synthetic polypeptide
EVQLLESGGGLVQPGGSLRLSCAASGFTFSYYHMSWVRQAPGKGLEWVSVISPSGGSTKYADSVKGRFTISRDNSKNTLYLQMNSLRAEDTAVYYCARGGSSDYAWGSYRRPYYFDYWGQGTLVTVSSASTKGPSVFPLAPSSKS

SEQ ID NO: 248 - protein, 106 aa, Artificial Sequence
  Synthetic polypeptide
QSVLTQPPSVSVSPGQTASITCSGEKLGDKYVSWYQQKPGQSPSLVICEDSRRPSGIPERFSGSNSGNTATLTISGAQPMDEADYYCQAWDSSTAIFGPGTKVTVL

SEQ ID NO: 249 - protein, 141 aa, Artificial Sequence
  Synthetic polypeptide
EVQLLESGGGLVQPGGSLRLSCAASGFTFSYYMMVWVRQAPGKGLEWVSYIYSSGGHTVYADSVKGRFTISRDNSKNTLYLQMNSLRAEDTAVYYCARDLFLYDFWSKGAFDIWGQGTMVTVSSASTKGPSVFPLAPSSKS

SEQ ID NO: 250 - protein, 107 aa, Artificial Sequence
  Synthetic polypeptide
QSVLTQPPSVSVSPGQTASITCSGDKLGDKYTSWYQQRPGQSPVLVIYQDIKRPSGIPERFSGSNSGNTATLTISGTQAMDEADYYCQAWDSPNARVFGSGTKVTVL

SEQ ID NO: 251 - protein, 145 aa, Artificial Sequence
  Synthetic polypeptide
EVQLLESGGGLVQPGGSLRLSCAASGFTFSHYRMSWVRQAPGKGLEWVSSIYPSGGRTVYADSVKGRFTISRDNSKNTLYLQMNSLRAEDTAVYYCAKDKFEWRLLFRGIGNDAFDIWGQGTMVTVSSASTKGPSVFPLAPSSKS

SEQ ID NO: 252 - protein, 110 aa, Artificial Sequence
  Synthetic polypeptide
QSELTQPPSASETPGQRVTISCSGSSSNIGSNTVSWFQQLPGSAPRLLIYNDHRRPSGVPDRFSGSKSGTSASLVISGLQSQDEADYYCSAWDDSLNGVVFGGGTKLTVL

SEQ ID NO: 253 - protein, 146 aa, Artificial Sequence
  Synthetic polypeptide
EVQLLESGGGLVQPGGSLRLSCAASGFTFSRYEMYWVRQAPGKGLEWVSSISSSGGPTAYADSVKGRFTISRDNSKNTLYLQMNSLRAEDTAMYYCAKGTPKWELLLRSIYIENAFDIWGQGTMVTVSSASTKGPSVFPLAPSSKS

SEQ ID NO: 254 - protein, 112 aa, Artificial Sequence
  Synthetic polypeptide
QDIVMTQTPPSLPVNPGEPASISCRSSQSLSDDGNTYLDWYLQRPGQSPQLLIHTLSYRASGVPDRFSGSGSGTDFTLKISRVEAEDVGVYYCMQGTHWPPTFGQGTKVEIK

SEQ ID NO: 255 - protein, 138 aa, Artificial Sequence
  Synthetic polypeptide
EVQLLESGGGLVQPGGSLRLSCAASGFTFSFYAMHWVRQAPGKGLEWVSGIVPSGGRTHYADSVKGRFTISRDNSKNTLYLQMNSLRAEDTAVYYCATDSSGSPNPLFDYWGQGTLVTVSSASTKGPSVFPLAPSPKS

SEQ ID NO: 256 - protein, 113 aa, Artificial Sequence
  Synthetic polypeptide
QDIQMTQSPLSLSVTPGEPASISCRSSLSLLHSNGYNYLDWYVQRPGQSPQLLMYLSSTRASGVPDRFSGSGSGTDFTLEISRVEAEDVGVYYCMQPLETPPTFGGGTKVEIK

SEQ ID NO: 257 - protein, 142 aa, Artificial Sequence
  Synthetic polypeptide
EVQLLESGGGLVQPGGSLRLSCAASGFTFSYYEMDWVRQAPGKGLEWVSGISSSGGHTAYADSVKGRFTISRDNSKNTLYLQMNSLRAEDTATYYCARERRSSSRARYYYGMDVWGQGTTVTVSSASTKGPSVFPLAPSSKS

SEQ ID NO: 258 - protein, 109 aa, Artificial Sequence
  Synthetic polypeptide
QSVLIQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 259 - protein, 147 aa, Artificial Sequence
  Synthetic polypeptide
EVQLLESGGGLVQPGGSLRLSCAASGFTFSDYRMQWVRQAPGKGLEWVSVIVPSGGNTMYADSVKGRFTISRDNSKNTLYLQMNSLRAEDTAVYYCARGGPGSSIAARRAPTGYYGMDVWGQGTTVTVSSASTKGPSVFPLAPSSKS

SEQ ID NO: 260 - protein, 108 aa, Artificial Sequence
  Synthetic polypeptide
QDIQMTQSPSSLSAFVGDRVTITCRASQPIDNYLNWYHQKPGKAPKLLIYAASRLQSGVPSRLSGSGFGTDFTLTISSLQPEDFGNYYCQQSYTVPYTFGGGTKVEIR

SEQ ID NO: 261 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRELKSNYFDYWGQGTLVTVSSASTKGPSVFPLAPSSKS

SEQ ID NO: 262 - protein, 110 aa, Artificial Sequence; identical to SEQ ID NO: 246
  Synthetic polypeptide

SEQ ID NO: 263 - protein, 145 aa, Artificial Sequence; identical to SEQ ID NO: 247
  Synthetic polypeptide

SEQ ID NO: 264 - protein, 107 aa, Artificial Sequence; identical to SEQ ID NO: 250
  Synthetic polypeptide

SEQ ID NO: 265 - protein, 145 aa, Artificial Sequence; identical to SEQ ID NO: 251
  Synthetic polypeptide

SEQ ID NO: 266 - protein, 108 aa, Artificial Sequence
  Synthetic polypeptide
QDIQMTQSPSSLSASVGDRVTITCRASGDIGNALGWYQQKPGKAPRLLISDASTLQSGVPLRFSGSGSGTEFTLTISSLQPEDFATYYCLQGYNYPRTFGQGTKLEIR

SEQ ID NO: 267 - protein, 141 aa, Artificial Sequence
  Synthetic polypeptide
EVQLLESGGGLVQPGGSLRLSCAASGFTFSRYIMHWVRQAPGKGLEWVSSISPSGGLTSYADSVKGRFTISRDNSKNTLYLQMNSLRAEDTAVYYCAREFENAYHYYYYGMDVWGQGTTVTVSSASTKGPSVFPLAPSSKS

SEQ ID NO: 268 - protein, 108 aa, Artificial Sequence
  Synthetic polypeptide
QDIQMTQSPSSLSASVGDRVTITCRASQSISSYLSWYQQRPGKAPNLLIYAASSLQSGVPSRFSGSGSGTDFTLTISSLQPEDFATYYCQQSISIPRTFGQGTKVEVK

SEQ ID NO: 269 - protein, 146 aa, Artificial Sequence
  Synthetic polypeptide
EVQLLESGGGLVQPGGSLRLSCAASGFTFSPYFMGWVRQAPGKGLEWVSGIGPSGGSTTYADSVKGRFTISRDNSKNTLYLQMNSLRAEDTAVYYCAREGPPYSSGWYRGLRQYHFDYWGQGTLVTVSSASTKGPSVFPLAPSSKS

SEQ ID NO: 270 - protein, 108 aa, Artificial Sequence
  Synthetic polypeptide
QDIQMTQSPSFLSASVGDRVTITCRASQGISSYLAWYQQKPGKAPKLLIYAASTLQSGVPSRFSGSGSGTEFTLTISSLQPEDFATYYCQQLNSYPLTFGGGTKVEIK

SEQ ID NO: 271 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 272 - protein, 106 aa, Artificial Sequence
  Synthetic polypeptide
QSALTQPPSVSVSPGQTASITCSGDKLGDKYVSWYQQRPGQSPVLVIYQDTKRPSGIPERFSGSNSGNTATLTISGTQAVDEADYYCQAWDSSTYVFGGGTKVTVL

SEQ ID NO: 273 - protein, 147 aa, Artificial Sequence
  Synthetic polypeptide
EVQLLESGGGLVQPGGSLRLSCAASGFTFSDYAMKWVRQAPGKGLEWVSSISSSGGVTQYADSVKGRFTISRDNSKNTLYLQMNSLRAEDTAVYYCAREEDYSSSWYSRRFDYYYGMDVWGQGTTVTVSSASTKGPSVFPLAPSSKS

SEQ ID NO: 274 - protein, 107 aa, Artificial Sequence
  Synthetic polypeptide
QDIQMTQSPSTLSASVGDRVTITCRASQSISSWLAWYQQKPGKAPNLLIYKASTLESGVPSRFSGSGSGTEFTLTISSLQPDDFATYYCQQYNTYWTFGQGTKVEIK

SEQ ID NO: 275 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDIWGQGTMVTVSSASTKGPSVFPLAPSSKS

SEQ ID NO: 276 - protein, 108 aa, Artificial Sequence; identical to SEQ ID NO: 260
  Synthetic polypeptide

SEQ ID NO: 277 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWSRELKSNYFDYWGQGTLVTVSSASTKGPSVFPLAPSSKS

SEQ ID NO: 278 - protein, 108 aa, Artificial Sequence; identical to SEQ ID NO: 260
  Synthetic polypeptide

SEQ ID NO: 279 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWMRELKSNYFDYWGQGTLVTVSSASTKGPSVFPLAPSSKS

SEQ ID NO: 280 - protein, 108 aa, Artificial Sequence; identical to SEQ ID NO: 260
  Synthetic polypeptide

SEQ ID NO: 281 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWGRELKSNYFDYWGQGTLVTVSSASTKGPSVFPLAPSSKS

SEQ ID NO: 282 - protein, 108 aa, Artificial Sequence; identical to SEQ ID NO: 260
  Synthetic polypeptide

SEQ ID NO: 283 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWNRELKSNYFDYWGQGTLVTVSSASTKGPSVFPLAPSSKS

SEQ ID NO: 284 - protein, 108 aa, Artificial Sequence; identical to SEQ ID NO: 260
  Synthetic polypeptide

SEQ ID NO: 285 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWDRELKSNYFDYWGQGTLVTVSSASTKGPSVFPLAPSSKS

SEQ ID NO: 286 - protein, 108 aa, Artificial Sequence; identical to SEQ ID NO: 260
  Synthetic polypeptide

SEQ ID NO: 287 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWQRELKSNYFDYWGQGTLVTVSSASTKGPSVFPLAPSSKS

SEQ ID NO: 288 - protein, 108 aa, Artificial Sequence; identical to SEQ ID NO: 260
  Synthetic polypeptide

SEQ ID NO: 289 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWTRELKSNYFDYWGQGTLVTVSSASTKGPSVFPLAPSSKS

SEQ ID NO: 290 - protein, 108 aa, Artificial Sequence; identical to SEQ ID NO: 260
  Synthetic polypeptide

SEQ ID NO: 291 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWARELKSNYFDYWGQGTLVTVSSASTKGPSVFPLAPSSKS

SEQ ID NO: 292 - protein, 108 aa, Artificial Sequence; identical to SEQ ID NO: 260
  Synthetic polypeptide

SEQ ID NO: 293 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWERELKSNYFDYWGQGTLVTVSSASTKGPSVFPLAPSSKS

SEQ ID NO: 294 - protein, 11 aa, Artificial Sequence
  Synthetic polypeptide
RASQSISMYLN

SEQ ID NO: 295 - protein, 11 aa, Artificial Sequence
  Synthetic polypeptide
RASQRISFYLN

SEQ ID NO: 296 - protein, 11 aa, Artificial Sequence
  Synthetic polypeptide
RASQSISSYLN

SEQ ID NO: 297 - protein, 11 aa, Artificial Sequence
  Synthetic polypeptide
RASQSISSYLN

SEQ ID NO: 298 - protein, 11 aa, Artificial Sequence
  Synthetic polypeptide
RASQSISTYLN

SEQ ID NO: 299 - protein, 11 aa, Artificial Sequence
  Synthetic polypeptide
SGDKLGDKYTS

SEQ ID NO: 300 - protein, 11 aa, Artificial Sequence
  Synthetic polypeptide
RASQDISSWLV

SEQ ID NO: 301 - protein, 11 aa, Artificial Sequence
  Synthetic polypeptide
RASQSISSYLN

SEQ ID NO: 302 - protein, 11 aa, Artificial Sequence
  Synthetic polypeptide
RASQGVSYYLA

SEQ ID NO: 303 - protein, 11 aa, Artificial Sequence
  Synthetic polypeptide
RASQYISTYLN

SEQ ID NO: 304 - protein, 11 aa, Artificial Sequence
  Synthetic polypeptide
RASQNIDIYLN

SEQ ID NO: 305 - protein, 11 aa, Artificial Sequence
  Synthetic polypeptide
RASQRISTYLN

SEQ ID NO: 306 - protein, 11 aa, Artificial Sequence
  Synthetic polypeptide
RASQSISIYVN

SEQ ID NO: 307 - protein, 11 aa, Artificial Sequence
  Synthetic polypeptide
RASQGISSYLN

SEQ ID NO: 308 - protein, 11 aa, Artificial Sequence
  Synthetic polypeptide
RASRTISFYLN

SEQ ID NO: 309 - protein, 11 aa, Artificial Sequence
  Synthetic polypeptide
RASQSISGYLN

SEQ ID NO: 310 - protein, 11 aa, Artificial Sequence
  Synthetic polypeptide
RASQSISSYLN

SEQ ID NO: 311 - protein, 11 aa, Artificial Sequence
  Synthetic polypeptide
RASQSISSYLN

SEQ ID NO: 312 - protein, 11 aa, Artificial Sequence
  Synthetic polypeptide
RASQSINTYLN

SEQ ID NO: 313 - protein, 11 aa, Artificial Sequence
  Synthetic polypeptide
RASQSISSYLN

SEQ ID NO: 314 - protein, 11 aa, Artificial Sequence
  Synthetic polypeptide
RASRSIATYLN

SEQ ID NO: 315 - protein, 11 aa, Artificial Sequence
  Synthetic polypeptide
SGDKLGNRYTS

SEQ ID NO: 316 - protein, 11 aa, Artificial Sequence
  Synthetic polypeptide
RASQSISSYLN

SEQ ID NO: 317 - protein, 11 aa, Artificial Sequence
  Synthetic polypeptide
RASQRISFYLN

SEQ ID NO: 318 - protein, 11 aa, Artificial Sequence
  Synthetic polypeptide
RASRDISVYLN

SEQ ID NO: 319 - protein, 11 aa, Artificial Sequence
  Synthetic polypeptide
RASQSISTYLN

SEQ ID NO: 320 - protein, 11 aa, Artificial Sequence
  Synthetic polypeptide
RASQSISIYLN

SEQ ID NO: 321 - protein, 16 aa, Artificial Sequence
  Synthetic polypeptide
RSSQSLLHSNGYNYLD

SEQ ID NO: 322 - protein, 11 aa, Artificial Sequence
  Synthetic polypeptide
RASQSISTYLN

SEQ ID NO: 323 - protein, 11 aa, Artificial Sequence
  Synthetic polypeptide
RASQTIDDDLI

SEQ ID NO: 324 - protein, 11 aa, Artificial Sequence
  Synthetic polypeptide
RASQSISGYIN

SEQ ID NO: 325 - protein, 11 aa, Artificial Sequence
  Synthetic polypeptide
RASQSIDTYLN

SEQ ID NO: 326 - protein, 11 aa, Artificial Sequence
  Synthetic polypeptide
RASQSISSYLN

SEQ ID NO: 327 - protein, 11 aa, Artificial Sequence
  Synthetic polypeptide
RASQSISIYLT

SEQ ID NO: 328 - protein, 11 aa, Artificial Sequence
  Synthetic polypeptide
RTSQTINNYLN

SEQ ID NO: 329 - protein, 11 aa, Artificial Sequence
  Synthetic polypeptide
RASRGIGTYLN

SEQ ID NO: 330 - protein, 11 aa, Artificial Sequence
  Synthetic polypeptide
RTSQGINHYLN

SEQ ID NO: 331 - protein, 11 aa, Artificial Sequence
  Synthetic polypeptide
RASQTISVYVN

SEQ ID NO: 332 - protein, 11 aa, Artificial Sequence
  Synthetic polypeptide
RASQSISRYLN

SEQ ID NO: 333 - protein, 11 aa, Artificial Sequence
  Synthetic polypeptide
RASQGIRNDLG

SEQ ID NO: 334 - protein, 11 aa, Artificial Sequence
  Synthetic polypeptide
RASQSIGIYLN

SEQ ID NO: 335 - protein, 11 aa, Artificial Sequence
  Synthetic polypeptide
SGDKLGEKYVS

SEQ ID NO: 336 - protein, 11 aa, Artificial Sequence
  Synthetic polypeptide
RASQSISSYLN

SEQ ID NO: 337 - protein, 11 aa, Artificial Sequence
  Synthetic polypeptide
RASQSISTYLN

SEQ ID NO: 338 - protein, 11 aa, Artificial Sequence
  Synthetic polypeptide
RASQSISAYLN

SEQ ID NO: 339 - protein, 11 aa, Artificial Sequence
  Synthetic polypeptide
RASQSISSYLN

SEQ ID NO: 340 - protein, 11 aa, Artificial Sequence
  Synthetic polypeptide
SGDKLGDEYAA

SEQ ID NO: 341 - protein, 11 aa, Artificial Sequence
  Synthetic polypeptide
RASQSISSYLN

SEQ ID NO: 342 - protein, 11 aa, Artificial Sequence
  Synthetic polypeptide
RASQSISSYLN

SEQ ID NO: 343 - protein, 11 aa, Artificial Sequence
  Synthetic polypeptide
RASQGISSYLA

SEQ ID NO: 344 - protein, 11 aa, Artificial Sequence
  Synthetic polypeptide
RASQSISTYLN

SEQ ID NO: 345 - protein, 11 aa, Artificial Sequence
  Synthetic polypeptide
RASQRISYYLT

SEQ ID NO: 346 - protein, 11 aa, Artificial Sequence
  Synthetic polypeptide
RTRQSISNYLN

SEQ ID NO: 347 - protein, 11 aa, Artificial Sequence
  Synthetic polypeptide
RASQSISNYLN

SEQ ID NO: 348 - protein, 11 aa, Artificial Sequence
  Synthetic polypeptide
RASQSISSYLN

SEQ ID NO: 349 - protein, 11 aa, Artificial Sequence
  Synthetic polypeptide
RASQSINFYLN

SEQ ID NO: 350 - protein, 11 aa, Artificial Sequence
  Synthetic polypeptide
RTSRRIGTYLN

SEQ ID NO: 351 - protein, 11 aa, Artificial Sequence
  Synthetic polypeptide
RASQSIATYLN

SEQ ID NO: 352 - protein, 11 aa, Artificial Sequence
  Synthetic polypeptide
RASQSISSYLN

SEQ ID NO: 353 - protein, 11 aa, Artificial Sequence
  Synthetic polypeptide
RASQDISNWLA

SEQ ID NO: 354 - protein, 11 aa, Artificial Sequence
  Synthetic polypeptide
RASQSINTYLN

SEQ ID NO: 355 - protein, 11 aa, Artificial Sequence
  Synthetic polypeptide
RASQSISSYLN

SEQ ID NO: 356 - protein, 11 aa, Artificial Sequence
  Synthetic polypeptide
RASQGISSWLA

SEQ ID NO: 357 - protein, 11 aa, Artificial Sequence
  Synthetic polypeptide
RASQSISSYLN

SEQ ID NO: 358 - protein, 11 aa, Artificial Sequence
  Synthetic polypeptide
RASQSITIYLN

SEQ ID NO: 359 - protein, 13 aa, Artificial Sequence
  Synthetic polypeptide
SGSSSNIGNNAVS

SEQ ID NO: 360 - protein, 11 aa, Artificial Sequence
  Synthetic polypeptide
RASQNIGNDVA

SEQ ID NO: 361 - protein, 11 aa, Artificial Sequence
  Synthetic polypeptide
RASQSISIYLN

SEQ ID NO: 362 - protein, 11 aa, Artificial Sequence
  Synthetic polypeptide
RTSQNINTYLN

SEQ ID NO: 363 - protein, 11 aa, Artificial Sequence
  Synthetic polypeptide
RASQTIDNYLH

SEQ ID NO: 364 - protein, 11 aa, Artificial Sequence
  Synthetic polypeptide
RASQSISSYLN

SEQ ID NO: 365 - protein, 11 aa, Artificial Sequence
  Synthetic polypeptide
RASQSISTYLN

SEQ ID NO: 366 - protein, 11 aa, Artificial Sequence
  Synthetic polypeptide
RASQDISVYLN

SEQ ID NO: 367 - protein, 11 aa, Artificial Sequence
  Synthetic polypeptide
RASQNISSYLN

SEQ ID NO: 368 - protein, 16 aa, Artificial Sequence
  Synthetic polypeptide
RSSQSLLHSRGYNYLD

SEQ ID NO: 369 - protein, 7 aa, Artificial Sequence
  Synthetic polypeptide
GTSSLQS

SEQ ID NO: 370 - protein, 7 aa, Artificial Sequence
  Synthetic polypeptide
GASSLQS

SEQ ID NO: 371 - protein, 7 aa, Artificial Sequence
  Synthetic polypeptide
AASSLQS

SEQ ID NO: 372 - protein, 7 aa, Artificial Sequence
  Synthetic polypeptide
GASSLQS

SEQ ID NO: 373 - protein, 7 aa, Artificial Sequence
  Synthetic polypeptide
NAFSMER

SEQ ID NO: 374 - protein, 7 aa, Artificial Sequence
  Synthetic polypeptide
QDSKRPS

SEQ ID NO: 375 - protein, 7 aa, Artificial Sequence
  Synthetic polypeptide
DASNLQS

SEQ ID NO: 376 - protein, 7 aa, Artificial Sequence
  Synthetic polypeptide
AASSLQS

SEQ ID NO: 377 - protein, 7 aa, Artificial Sequence
  Synthetic polypeptide
GASSLQS

SEQ ID NO: 378 - protein, 7 aa, Artificial Sequence
  Synthetic polypeptide
GTSSLQS

SEQ ID NO: 379 - protein, 7 aa, Artificial Sequence
  Synthetic polypeptide
GAYNLQS

SEQ ID NO: 380 - protein, 7 aa, Artificial Sequence
  Synthetic polypeptide
GASSLQS

SEQ ID NO: 381 - protein, 7 aa, Artificial Sequence
  Synthetic polypeptide
AASSLQR

SEQ ID NO: 382 - protein, 7 aa, Artificial Sequence
  Synthetic polypeptide
GASSLQS

SEQ ID NO: 383 - protein, 7 aa, Artificial Sequence
  Synthetic polypeptide
GGSSLHS

SEQ ID NO: 384 - protein, 7 aa, Artificial Sequence
  Synthetic polypeptide
AASNLQT

SEQ ID NO: 385 - protein, 7 aa, Artificial Sequence
  Synthetic polypeptide
AASSLQS

SEQ ID NO: 386 - protein, 7 aa, Artificial Sequence
  Synthetic polypeptide
AASSLQS

SEQ ID NO: 387 - protein, 7 aa, Artificial Sequence
  Synthetic polypeptide
AASTLES

SEQ ID NO: 388 - protein, 7 aa, Artificial Sequence
  Synthetic polypeptide
AASSLQS

SEQ ID NO: 389 - protein, 7 aa, Artificial Sequence
  Synthetic polypeptide
GASTLQS

SEQ ID NO: 390 - protein, 7 aa, Artificial Sequence
  Synthetic polypeptide
QDNKRPS

SEQ ID NO: 391 - protein, 7 aa, Artificial Sequence
  Synthetic polypeptide
AASSLQS

SEQ ID NO: 392 - protein, 7 aa, Artificial Sequence
  Synthetic polypeptide
GASSLQS

SEQ ID NO: 393 - protein, 7 aa, Artificial Sequence
  Synthetic polypeptide
GASSLQS

SEQ ID NO: 394 - protein, 7 aa, Artificial Sequence
  Synthetic polypeptide
GASSLQS

SEQ ID NO: 395 - protein, 7 aa, Artificial Sequence
  Synthetic polypeptide
AASTLQS

SEQ ID NO: 396 - protein, 7 aa, Artificial Sequence
  Synthetic polypeptide
LGSNRAS

SEQ ID NO: 397 - protein, 7 aa, Artificial Sequence
  Synthetic polypeptide
GASSLQS

SEQ ID NO: 398 - protein, 7 aa, Artificial Sequence
  Synthetic polypeptide
AASSLQS

SEQ ID NO: 399 - protein, 7 aa, Artificial Sequence
  Synthetic polypeptide
AASSLQS

SEQ ID NO: 400 - protein, 5 aa, Artificial Sequence
  Synthetic polypeptide
DASNL

SEQ ID NO: 401 - protein, 7 aa, Artificial Sequence
  Synthetic polypeptide
AASSLQS

SEQ ID NO: 402 - protein, 7 aa, Artificial Sequence
  Synthetic polypeptide
GAATLQT

SEQ ID NO: 403 - protein, 7 aa, Artificial Sequence
  Synthetic polypeptide
ATHTLES

SEQ ID NO: 404 - protein, 7 aa, Artificial Sequence
  Synthetic polypeptide
AASSLET

SEQ ID NO: 405 - protein, 7 aa, Artificial Sequence
  Synthetic polypeptide
AASELQT

SEQ ID NO: 406 - protein, 7 aa, Artificial Sequence
  Synthetic polypeptide
GASSLQS

SEQ ID NO: 407 - protein, 7 aa, Artificial Sequence
  Synthetic polypeptide
AASTLET

SEQ ID NO: 408 - protein, 7 aa, Artificial Sequence
  Synthetic polypeptide
AASILQS

SEQ ID NO: 409 - protein, 7 aa, Artificial Sequence
  Synthetic polypeptide
GASSLQS

SEQ ID NO: 410 - protein, 7 aa, Artificial Sequence
  Synthetic polypeptide
QDNKRPS

SEQ ID NO: 411 - protein, 7 aa, Artificial Sequence
  Synthetic polypeptide
AASSLQS

SEQ ID NO: 412 - protein, 7 aa, Artificial Sequence
  Synthetic polypeptide
GAFSLQS

SEQ ID NO: 413 - protein, 8 aa, Artificial Sequence
  Synthetic polypeptide
YGVGSLQS

SEQ ID NO: 414 - protein, 7 aa, Artificial Sequence
  Synthetic polypeptide
AASSLQS

SEQ ID NO: 415 - protein, 7 aa, Artificial Sequence
  Synthetic polypeptide
QDRKRPS

SEQ ID NO: 416 - protein, 7 aa, Artificial Sequence
  Synthetic polypeptide
AASSLQS

SEQ ID NO: 417 - protein, 7 aa, Artificial Sequence
  Synthetic polypeptide
AASSLQS

SEQ ID NO: 418 - protein, 7 aa, Artificial Sequence
  Synthetic polypeptide
AASSLQS

SEQ ID NO: 419 - protein, 7 aa, Artificial Sequence
  Synthetic polypeptide
GASSLQS

SEQ ID NO: 420 - protein, 7 aa, Artificial Sequence
  Synthetic polypeptide
AASSLES

SEQ ID NO: 421 - protein, 7 aa, Artificial Sequence
  Synthetic polypeptide
AASSLQS

SEQ ID NO: 422 - protein, 7 aa, Artificial Sequence
  Synthetic polypeptide
AASSLQS

SEQ ID NO: 423 - protein, 7 aa, Artificial Sequence
  Synthetic polypeptide
AASSLQS

SEQ ID NO: 424 - protein, 7 aa, Artificial Sequence
  Synthetic polypeptide
VASSLES

SEQ ID NO: 425 - protein, 7 aa, Artificial Sequence
  Synthetic polypeptide
GASSLQS

SEQ ID NO: 426 - protein, 7 aa, Artificial Sequence
  Synthetic polypeptide
AASSLQS

SEQ ID NO: 427 - protein, 7 aa, Artificial Sequence
  Synthetic polypeptide
AASSLQS

SEQ ID NO: 428 - protein, 7 aa, Artificial Sequence
  Synthetic polypeptide
AASSLQT

SEQ ID NO: 429 - protein, 7 aa, Artificial Sequence
  Synthetic polypeptide
AASTLES

SEQ ID NO: 430 - protein, 7 aa, Artificial Sequence
  Synthetic polypeptide
AASSLQS

SEQ ID NO: 431 - protein, 7 aa, Artificial Sequence
  Synthetic polypeptide
ATSGLQS

SEQ ID NO: 432 - protein, 7 aa, Artificial Sequence
  Synthetic polypeptide
AASSLQS

SEQ ID NO: 433 - protein, 7 aa, Artificial Sequence
  Synthetic polypeptide
GASNLHS

SEQ ID NO: 434 - protein, 7 aa, Artificial Sequence
  Synthetic polypeptide
YDDLLPS

SEQ ID NO: 435 - protein, 7 aa, Artificial Sequence
  Synthetic polypeptide
HASTRAY

SEQ ID NO: 436 - protein, 7 aa, Artificial Sequence
  Synthetic polypeptide
GASQLES

SEQ ID NO: 437 - protein, 7 aa, Artificial Sequence
  Synthetic polypeptide
GVSSLHR

SEQ ID NO: 438 - protein, 7 aa, Artificial Sequence
  Synthetic polypeptide
DASSLQS

SEQ ID NO: 439 - protein, 7 aa, Artificial Sequence
  Synthetic polypeptide
AASSLQS

SEQ ID NO: 440 - protein, 7 aa, Artificial Sequence
  Synthetic polypeptide
AASSLQS

SEQ ID NO: 441 - protein, 7 aa, Artificial Sequence
  Synthetic polypeptide
GGASLQS

SEQ ID NO: 442 - protein, 7 aa, Artificial Sequence
  Synthetic polypeptide
AASSLQS

SEQ ID NO: 443 - protein, 7 aa, Artificial Sequence
  Synthetic polypeptide
LGSNRAS

SEQ ID NO: 444 - protein, 9 aa, Artificial Sequence
  Synthetic polypeptide
QQSYSAPWT

SEQ ID NO: 445 - protein, 9 aa, Artificial Sequence
  Synthetic polypeptide
QQTFSTPNT

SEQ ID NO: 446 - protein, 9 aa, Artificial Sequence
  Synthetic polypeptide
QQSYSTLWT

SEQ ID NO: 447 - protein, 8 aa, Artificial Sequence
  Synthetic polypeptide
QQSYTRWT

SEQ ID NO: 448 - protein, 9 aa, Artificial Sequence
  Synthetic polypeptide
QQSYTTPTT

SEQ ID NO: 449 - protein, 8 aa, Artificial Sequence
  Synthetic polypeptide
QAWDSSTV

SEQ ID NO: 450 - protein, 9 aa, Artificial Sequence
  Synthetic polypeptide
QQADGFPLT

SEQ ID NO: 451 - protein, 10 aa, Artificial Sequence
  Synthetic polypeptide
QQSYSTLMYT

SEQ ID NO: 452 - protein, 9 aa, Artificial Sequence
  Synthetic polypeptide
QQYNTYPPT

SEQ ID NO: 453 - protein, 9 aa, Artificial Sequence
  Synthetic polypeptide
QQSFTTPFT

SEQ ID NO: 454 - protein, 8 aa, Artificial Sequence
  Synthetic polypeptide
QQSYGTPV

SEQ ID NO: 455 - protein, 9 aa, Artificial Sequence
  Synthetic polypeptide
QQSYNTPRT

SEQ ID NO: 456 - protein, 9 aa, Artificial Sequence
  Synthetic polypeptide
QQSFSTPLT

SEQ ID NO: 457 - protein, 9 aa, Artificial Sequence
  Synthetic polypeptide
QESYSTLFT

SEQ ID NO: 458 - protein, 9 aa, Artificial Sequence
  Synthetic polypeptide
QQSFSSPWT

SEQ ID NO: 459 - protein, 9 aa, Artificial Sequence
  Synthetic polypeptide
QQSHTPPKT

SEQ ID NO: 460 - protein, 10 aa, Artificial Sequence
  Synthetic polypeptide
QQSYSTPPYT

SEQ ID NO: 461 - protein, 9 aa, Artificial Sequence
  Synthetic polypeptide
QQTYTTPWT

SEQ ID NO: 462 - protein, 9 aa, Artificial Sequence
  Synthetic polypeptide
QQSYSTPYT

SEQ ID NO: 463 - protein, 9 aa, Artificial Sequence
  Synthetic polypeptide
QQSYSTPIT

SEQ ID NO: 464 - protein, 9 aa, Artificial Sequence
  Synthetic polypeptide
QQSFSDPYT

SEQ ID NO: 465 - protein, 9 aa, Artificial Sequence
  Synthetic polypeptide
QALDSNTYV

SEQ ID NO: 466 - protein, 9 aa, Artificial Sequence
  Synthetic polypeptide
QQSYSTPPT

SEQ ID NO: 467 - protein, 9 aa, Artificial Sequence
  Synthetic polypeptide
QQTFSTPNT

SEQ ID NO: 468 - protein, 9 aa, Artificial Sequence
  Synthetic polypeptide
QQSYSIPFT

SEQ ID NO: 469 - protein, 9 aa, Artificial Sequence
  Synthetic polypeptide
QQSFSTPWT

SEQ ID NO: 470 - protein, 9 aa, Artificial Sequence
  Synthetic polypeptide
QQSHSIPPT

SEQ ID NO: 471 - protein, 9 aa, Artificial Sequence
  Synthetic polypeptide
MQALQTPLT

SEQ ID NO: 472 - protein, 9 aa, Artificial Sequence
  Synthetic polypeptide
QQSYSDPYT

SEQ ID NO: 473 - protein, 9 aa, Artificial Sequence
  Synthetic polypeptide
QQSYNIPRT

SEQ ID NO: 474 - protein, 9 aa, Artificial Sequence
  Synthetic polypeptide
QQYVSYPFT

SEQ ID NO: 475 - protein, 9 aa, Artificial Sequence
  Synthetic polypeptide
QHYLYAPYS

SEQ ID NO: 476 - protein, 9 aa, Artificial Sequence
  Synthetic polypeptide
QQSYSTPPT

SEQ ID NO: 477 - protein, 9 aa, Artificial Sequence
  Synthetic polypeptide
QQTFSLPRT

SEQ ID NO: 478 - protein, 9 aa, Artificial Sequence
  Synthetic polypeptide
QQSFAFPYT

SEQ ID NO: 479 - protein, 9 aa, Artificial Sequence
  Synthetic polypeptide
QESFTNVYN

SEQ ID NO: 480 - protein, 9 aa, Artificial Sequence
  Synthetic polypeptide
QQTYTSPYT

SEQ ID NO: 481 - protein, 9 aa, Artificial Sequence
  Synthetic polypeptide
QQSYSIPFT

SEQ ID NO: 482 - protein, 9 aa, Artificial Sequence
  Synthetic polypeptide
QQSYSTPYT

SEQ ID NO: 483 - protein, 9 aa, Artificial Sequence
  Synthetic polypeptide
LQDYEYPLT

SEQ ID NO: 484 - protein, 9 aa, Artificial Sequence
  Synthetic polypeptide
QHSYSTPFT

SEQ ID NO: 485 - protein, 9 aa, Artificial Sequence
  Synthetic polypeptide
QAWDSYTVV

SEQ ID NO: 486 - protein, 9 aa, Artificial Sequence
  Synthetic polypeptide
QQSYSTPPT

SEQ ID NO: 487 - protein, 9 aa, Artificial Sequence
  Synthetic polypeptide
QQSHSTPPT

SEQ ID NO: 488 - protein, 9 aa, Artificial Sequence
  Synthetic polypeptide
QQGYTTPVT

SEQ ID NO: 489 - protein, 9 aa, Artificial Sequence
  Synthetic polypeptide
QQSYSTPYT

SEQ ID NO: 490 - protein, 9 aa, Artificial Sequence
  Synthetic polypeptide
QAWGKRNVV

SEQ ID NO: 491 - protein, 9 aa, Artificial Sequence
  Synthetic polypeptide
QQSYSTPRT

SEQ ID NO: 492 - protein, 9 aa, Artificial Sequence
  Synthetic polypeptide
QQSYSTPPT

SEQ ID NO: 493 - protein, 9 aa, Artificial Sequence
  Synthetic polypeptide
QQSYNTLRT

SEQ ID NO: 494 - protein, 9 aa, Artificial Sequence
  Synthetic polypeptide
QQSYSDPYT

SEQ ID NO: 495 - protein, 9 aa, Artificial Sequence
  Synthetic polypeptide
QQAFSTPFT

SEQ ID NO: 496 - protein, 9 aa, Artificial Sequence
  Synthetic polypeptide
QQSYDIPFT

SEQ ID NO: 497 - protein, 9 aa, Artificial Sequence
  Synthetic polypeptide
QQSYSTPQT

SEQ ID NO: 498 - protein, 8 aa, Artificial Sequence
  Synthetic polypeptide
QQSYSTLT

SEQ ID NO: 499 - protein, 9 aa, Artificial Sequence
  Synthetic polypeptide
LQSYSAPYT

SEQ ID NO: 500 - protein, 9 aa, Artificial Sequence
  Synthetic polypeptide
QQSFSSPWT

SEQ ID NO: 501 - protein, 9 aa, Artificial Sequence
  Synthetic polypeptide
QQSYSTRET

SEQ ID NO: 502 - protein, 9 aa, Artificial Sequence
  Synthetic polypeptide
QQTYTTPWT

SEQ ID NO: 503 - protein, 9 aa, Artificial Sequence
  Synthetic polypeptide
QQSYSLPWT

SEQ ID NO: 504 - protein, 9 aa, Artificial Sequence
  Synthetic polypeptide
QQSYSTPPT

SEQ ID NO: 505 - protein, 9 aa, Artificial Sequence
  Synthetic polypeptide
QQSYSTPLT

SEQ ID NO: 506 - protein, 9 aa, Artificial Sequence
  Synthetic polypeptide
QQAKSFPLT

SEQ ID NO: 507 - protein, 9 aa, Artificial Sequence
  Synthetic polypeptide
QQSYSTRYT

SEQ ID NO: 508 - protein, 9 aa, Artificial Sequence
  Synthetic polypeptide
QQSYDTPLT

SEQ ID NO: 509 - protein, 11 aa, Artificial Sequence
  Synthetic polypeptide
AAWDDSLNGFV

SEQ ID NO: 510 - protein, 10 aa, Artificial Sequence
  Synthetic polypeptide
QQFYDWPAHT

SEQ ID NO: 511 - protein, 9 aa, Artificial Sequence
  Synthetic polypeptide
QQSYNVPYT

SEQ ID NO: 512 - protein, 9 aa, Artificial Sequence
  Synthetic polypeptide
QQSYSSPWT

SEQ ID NO: 513 - protein, 10 aa, Artificial Sequence
  Synthetic polypeptide
QQSYDTPQYT

SEQ ID NO: 514 - protein, 10 aa, Artificial Sequence
  Synthetic polypeptide
QQSYSTPPWT

SEQ ID NO: 515 - protein, 9 aa, Artificial Sequence
  Synthetic polypeptide
QQSYSTPHT

SEQ ID NO: 516 - protein, 9 aa, Artificial Sequence
  Synthetic polypeptide
QQSYSLPFT

SEQ ID NO: 517 - protein, 9 aa, Artificial Sequence
  Synthetic polypeptide
QQSYSTPRT

SEQ ID NO: 518 - protein, 8 aa, Artificial Sequence
  Synthetic polypeptide
MQALQRRT

SEQ ID NO: 519 - protein, 5 aa, Artificial Sequence
  Synthetic polypeptide
LYQMT

SEQ ID NO: 520 - protein, 5 aa, Artificial Sequence
  Synthetic polypeptide
PYPMQ

SEQ ID NO: 521 - protein, 5 aa, Artificial Sequence
  Synthetic polypeptide
KYFMG

SEQ ID NO: 522 - protein, 5 aa, Artificial Sequence
  Synthetic polypeptide
RYHMV

SEQ ID NO: 523 - protein, 5 aa, Artificial Sequence
  Synthetic polypeptide
RYRMV

SEQ ID NO: 524 - protein, 5 aa, Artificial Sequence
  Synthetic polypeptide
YYPMQ

SEQ ID NO: 525 - protein, 5 aa, Artificial Sequence
  Synthetic polypeptide
LYNMN

SEQ ID NO: 526 - protein, 5 aa, Artificial Sequence
  Synthetic polypeptide
HYFMT

SEQ ID NO: 527 - protein, 5 aa, Artificial Sequence
  Synthetic polypeptide
LYEML

SEQ ID NO: 528 - protein, 5 aa, Artificial Sequence
  Synthetic polypeptide
GYWMG

SEQ ID NO: 529 - protein, 5 aa, Artificial Sequence
  Synthetic polypeptide
GYFMM

SEQ ID NO: 530 - protein, 5 aa, Artificial Sequence
  Synthetic polypeptide
AYEMW

SEQ ID NO: 531 - protein, 5 aa, Artificial Sequence
  Synthetic polypeptide
HYGMV

SEQ ID NO: 532 - protein, 5 aa, Artificial Sequence
  Synthetic polypeptide
LYPMQ

SEQ ID NO: 533 - protein, 5 aa, Artificial Sequence
  Synthetic polypeptide
WYKMM

SEQ ID NO: 534 - protein, 5 aa, Artificial Sequence
  Synthetic polypeptide
EYDMM

SEQ ID NO: 535 - protein, 5 aa, Artificial Sequence
  Synthetic polypeptide
PYAMT

SEQ ID NO: 536 - protein, 5 aa, Artificial Sequence
  Synthetic polypeptide
SYPMG

SEQ ID NO: 537 - protein, 5 aa, Artificial Sequence
  Synthetic polypeptide
DYDME

SEQ ID NO: 538 - protein, 5 aa, Artificial Sequence
  Synthetic polypeptide
YYTML

SEQ ID NO: 539 - protein, 5 aa, Artificial Sequence
  Synthetic polypeptide
AYMMI

SEQ ID NO: 540 - protein, 5 aa, Artificial Sequence
  Synthetic polypeptide
WYSMG

SEQ ID NO: 541 - protein, 5 aa, Artificial Sequence
  Synthetic polypeptide
AYTMW

SEQ ID NO: 542 - protein, 5 aa, Artificial Sequence
  Synthetic polypeptide
PYPMQ

SEQ ID NO: 543 - protein, 5 aa, Artificial Sequence
  Synthetic polypeptide
LYLMH

SEQ ID NO: 544 - protein, 5 aa, Artificial Sequence
  Synthetic polypeptide
WYEMS

SEQ ID NO: 545 - protein, 5 aa, Artificial Sequence
  Synthetic polypeptide
MYPMM

SEQ ID NO: 546 - protein, 5 aa, Artificial Sequence
  Synthetic polypeptide
AYPMN

SEQ ID NO: 547 - protein, 5 aa, Artificial Sequence
  Synthetic polypeptide
LYRMF

SEQ ID NO: 548 - protein, 5 aa, Artificial Sequence
  Synthetic polypeptide
NYDMM

SEQ ID NO: 549 - protein, 5 aa, Artificial Sequence
  Synthetic polypeptide
QYGMQ

SEQ ID NO: 550 - protein, 5 aa, Artificial Sequence
  Synthetic polypeptide
NYWMM

SEQ ID NO: 551 - protein, 5 aa, Artificial Sequence
  Synthetic polypeptide
TYEMY

SEQ ID NO: 552 - protein, 5 aa, Artificial Sequence
  Synthetic polypeptide
MYHMN

SEQ ID NO: 553 - protein, 5 aa, Artificial Sequence
  Synthetic polypeptide
WYTMG

SEQ ID NO: 554 - protein, 5 aa, Artificial Sequence
  Synthetic polypeptide
QYAMH

SEQ ID NO: 555 - protein, 5 aa, Artificial Sequence
  Synthetic polypeptide
LYNMT

SEQ ID NO: 556 - protein, 5 aa, Artificial Sequence
  Synthetic polypeptide
QYPMN

SEQ ID NO: 557 - protein, 5 aa, Artificial Sequence
  Synthetic polypeptide
WYYMG

SEQ ID NO: 558 - protein, 5 aa, Artificial Sequence
  Synthetic polypeptide
LYSMY

SEQ ID NO: 559 - protein, 5 aa, Artificial Sequence
  Synthetic polypeptide
SYAMV

SEQ ID NO: 560 - protein, 5 aa, Artificial Sequence
  Synthetic polypeptide
DYEMH

SEQ ID NO: 561 - protein, 5 aa, Artificial Sequence
  Synthetic polypeptide
NYPMD

SEQ ID NO: 562 - protein, 5 aa, Artificial Sequence
  Synthetic polypeptide
QYKML

SEQ ID NO: 563 - protein, 5 aa, Artificial Sequence
  Synthetic polypeptide
WYRMD

SEQ ID NO: 564 - protein, 5 aa, Artificial Sequence
  Synthetic polypeptide
DYTMW

SEQ ID NO: 565 - protein, 5 aa, Artificial Sequence
  Synthetic polypeptide
WYQMM

SEQ ID NO: 566 - protein, 5 aa, Artificial Sequence
  Synthetic polypeptide
SYMMH

SEQ ID NO: 567 - protein, 5 aa, Artificial Sequence
  Synthetic polypeptide
WYPMT

SEQ ID NO: 568 - protein, 5 aa, Artificial Sequence
  Synthetic polypeptide
SYHMM

SEQ ID NO: 569 - protein, 5 aa, Artificial Sequence
  Synthetic polypeptide
LYRMF

SEQ ID NO: 570 - protein, 5 aa, Artificial Sequence
  Synthetic polypeptide
AYYMV

SEQ ID NO: 571 - protein, 5 aa, Artificial Sequence
  Synthetic polypeptide
EYDMA

SEQ ID NO: 572 - protein, 5 aa, Artificial Sequence
  Synthetic polypeptide
AYQMA

SEQ ID NO: 573 - protein, 5 aa, Artificial Sequence
  Synthetic polypeptide
WYAMH

SEQ ID NO: 574 - protein, 5 aa, Artificial Sequence
  Synthetic polypeptide
YYQMG

SEQ ID NO: 575 - protein, 5 aa, Artificial Sequence
  Synthetic polypeptide
WYPMQ

SEQ ID NO: 576 - protein, 5 aa, Artificial Sequence
  Synthetic polypeptide
WYTMH

SEQ ID NO: 577 - protein, 5 aa, Artificial Sequence
  Synthetic polypeptide
SYPMG

SEQ ID NO: 578 - protein, 5 aa, Artificial Sequence
  Synthetic polypeptide
LYDMT

SEQ ID NO: 579 - protein, 5 aa, Artificial Sequence
  Synthetic polypeptide
VYLMH

SEQ ID NO: 580 - protein, 5 aa, Artificial Sequence
  Synthetic polypeptide
RYIMW

SEQ ID NO: 581 - protein, 5 aa, Artificial Sequence
  Synthetic polypeptide
DYTMY

SEQ ID NO: 582 - protein, 5 aa, Artificial Sequence
  Synthetic polypeptide
GYDMM

SEQ ID NO: 583 - protein, 5 aa, Artificial Sequence
  Synthetic polypeptide
WYPMY

SEQ ID NO: 584 - protein, 5 aa, Artificial Sequence
  Synthetic polypeptide
RYPMM

SEQ ID NO: 585 - protein, 5 aa, Artificial Sequence
  Synthetic polypeptide
YYHMW

SEQ ID NO: 586 - protein, 5 aa, Artificial Sequence
  Synthetic polypeptide
FYKMI

SEQ ID NO: 587 - protein, 5 aa, Artificial Sequence
  Synthetic polypeptide
QYLMM

SEQ ID NO: 588 - protein, 5 aa, Artificial Sequence
  Synthetic polypeptide
LYDMN

SEQ ID NO: 589 - protein, 5 aa, Artificial Sequence
  Synthetic polypeptide
LYAMW

SEQ ID NO: 590 - protein, 5 aa, Artificial Sequence
  Synthetic polypeptide
GYIMH

SEQ ID NO: 591 - protein, 5 aa, Artificial Sequence
  Synthetic polypeptide
MYWMQ

SEQ ID NO: 592 - protein, 5 aa, Artificial Sequence
  Synthetic polypeptide
LYIMG

SEQ ID NO: 593 - protein, 5 aa, Artificial Sequence
  Synthetic polypeptide
YYTMI

SEQ ID NO: 594 - protein, 17 aa, Artificial Sequence
  Synthetic polypeptide
GIWPSGGFTDYADSVKG

SEQ ID NO: 595 - protein, 17 aa, Artificial Sequence
  Synthetic polypeptide
SISSSGGMTEYADSVKG

SEQ ID NO: 596 - protein, 17 aa, Artificial Sequence
  Synthetic polypeptide
VIGSSGGWTSYADSVKG

SEQ ID NO: 597 - protein, 17 aa, Artificial Sequence
  Synthetic polypeptide
SISPSGGWTNYADSVKG

SEQ ID NO: 598 - protein, 17 aa, Artificial Sequence
  Synthetic polypeptide
SIYPSGGMTAYADSVKG

SEQ ID NO: 599 - protein, 17 aa, Artificial Sequence
  Synthetic polypeptide
YIYPSGGLTSYADSVKG

SEQ ID NO: 600 - protein, 17 aa, Artificial Sequence
  Synthetic polypeptide
SISPSGGFTDYADSVKG

SEQ ID NO: 601 - protein, 17 aa, Artificial Sequence
  Synthetic polypeptide
SIVPSGGMTQYADSVKG

SEQ ID NO: 602 - protein, 17 aa, Artificial Sequence
  Synthetic polypeptide
VIYPSGGYTDYADSVKG

SEQ ID NO: 603 - protein, 17 aa, Artificial Sequence
  Synthetic polypeptide
SISSSGGWTQYADSVKG

SEQ ID NO: 604 - protein, 17 aa, Artificial Sequence
  Synthetic polypeptide
SIYSSGGYTDYADSVKG

SEQ ID NO: 605 - protein, 17 aa, Artificial Sequence
  Synthetic polypeptide
YIGSSGGSTSYADSVKG

SEQ ID NO: 606 - protein, 17 aa, Artificial Sequence
  Synthetic polypeptide
YIVPSGGLTYYADSVKG

SEQ ID NO: 607 - protein, 17 aa, Artificial Sequence
  Synthetic polypeptide
SIGSSGGMTFYADSVKG

SEQ ID NO: 608 - protein, 17 aa, Artificial Sequence
  Synthetic polypeptide
SIYPSGGWTNYADSVKG

SEQ ID NO: 609 - protein, 17 aa, Artificial Sequence
  Synthetic polypeptide
SIGSSGGMTYYADSVKG

SEQ ID NO: 610 - protein, 17 aa, Artificial Sequence
  Synthetic polypeptide
VIYPSGGFTDYADSVKG

SEQ ID NO: 611 - protein, 17 aa, Artificial Sequence
  Synthetic polypeptide
RISSSGGMTIYADSVKG

SEQ ID NO: 612 - protein, 17 aa, Artificial Sequence
  Synthetic polypeptide
SISPSGGSTIYADSVKG

SEQ ID NO: 613 - protein, 17 aa, Artificial Sequence
  Synthetic polypeptide
SIYPSGGFTMYADSVKG

SEQ ID NO: 614 - protein, 17 aa, Artificial Sequence
  Synthetic polypeptide
VIYPSGGVTMYADSVKG

SEQ ID NO: 615 - protein, 17 aa, Artificial Sequence
  Synthetic polypeptide
YIVPSGGYTMYADSVKG

SEQ ID NO: 616 - protein, 17 aa, Artificial Sequence
  Synthetic polypeptide
SIWPSGGSTFYADSVKG

SEQ ID NO: 617 - protein, 17 aa, Artificial Sequence
  Synthetic polypeptide
SISSSGGMTEYADSVKG

SEQ ID NO: 618 - protein, 17 aa, Artificial Sequence
  Synthetic polypeptide
SIYSSGGFTTYADSVKG

SEQ ID NO: 619 - protein, 17 aa, Artificial Sequence
  Synthetic polypeptide
RIWPSGGVTMYADSVKG

SEQ ID NO: 620 - protein, 17 aa, Artificial Sequence
  Synthetic polypeptide
YISPSGGMTDYADSVKG

SEQ ID NO: 621 - protein, 17 aa, Artificial Sequence
  Synthetic polypeptide
RISSSGGNTSYADSVKG

SEQ ID NO: 622 - protein, 17 aa, Artificial Sequence
  Synthetic polypeptide
SIWSSGGPTMYADSVKG

SEQ ID NO: 623 - protein, 17 aa, Artificial Sequence
  Synthetic polypeptide
YISPSGGFTRYADSVKG

SEQ ID NO: 624 - protein, 17 aa, Artificial Sequence
  Synthetic polypeptide
SIRSSGGATRYADSVKG

SEQ ID NO: 625 - protein, 17 aa, Artificial Sequence
  Synthetic polypeptide
GIGSSGGFTSYADSVKG

SEQ ID NO: 626 - protein, 17 aa, Artificial Sequence
  Synthetic polypeptide
GIGSSGGMTMYADSVKG

SEQ ID NO: 627 - protein, 17 aa, Artificial Sequence
  Synthetic polypeptide
GIVSSGGVTFYADSVKG

SEQ ID NO: 628 - protein, 16 aa, Artificial Sequence
  Synthetic polypeptide
WIYFGGLTTYADSVKG

SEQ ID NO: 629 - protein, 17 aa, Artificial Sequence
  Synthetic polypeptide
SIYPSGGFTLYADSVKG

SEQ ID NO: 630 - protein, 17 aa, Artificial Sequence
  Synthetic polypeptide
YIYPSGGGTHYADSVKG

SEQ ID NO: 631 - protein, 17 aa, Artificial Sequence
  Synthetic polypeptide
SISSSGGFTTYADSVKG

SEQ ID NO: 632 - protein, 17 aa, Artificial Sequence
  Synthetic polypeptide
WIVSSGGLTLYADSVKG

SEQ ID NO: 633 - protein, 17 aa, Artificial Sequence
  Synthetic polypeptide
RIRPSGGGTVYADSVKG

SEQ ID NO: 634 - protein, 17 aa, Artificial Sequence
  Synthetic polypeptide
SIGSSGGFTLYADSVKG

SEQ ID NO: 635 - protein, 17 aa, Artificial Sequence
  Synthetic polypeptide
GISPSGGKTQYADSVKG

SEQ ID NO: 636 - protein, 17 aa, Artificial Sequence
  Synthetic polypeptide
SISSSGGWTNYADSVKG

SEQ ID NO: 637 - protein, 17 aa, Artificial Sequence
  Synthetic polypeptide
GIGPSGGLTAYADSVKG

SEQ ID NO: 638 - protein, 17 aa, Artificial Sequence
  Synthetic polypeptide
SIWPSGGLTSYADSVKG

SEQ ID NO: 639 - protein, 17 aa, Artificial Sequence
  Synthetic polypeptide
SISSSGGITFYADSVKG

SEQ ID NO: 640 - protein, 17 aa, Artificial Sequence
  Synthetic polypeptide
SISPSGGITEYADSVKG

SEQ ID NO: 641 - protein, 17 aa, Artificial Sequence
  Synthetic polypeptide
GIYPSGGWTDYADSVKG

SEQ ID NO: 642 - protein, 17 aa, Artificial Sequence
  Synthetic polypeptide
SIGPSGGQTIYADSVKG

SEQ ID NO: 643 - protein, 17 aa, Artificial Sequence
  Synthetic polypeptide
SIYPSGGATMYADSVKG

SEQ ID NO: 644 - protein, 17 aa, Artificial Sequence
  Synthetic polypeptide
SIWSSGGPTMYADSVKG

SEQ ID NO: 645 - protein, 17 aa, Artificial Sequence
  Synthetic polypeptide
YISPSGGQTQYADSVKG

SEQ ID NO: 646 - protein, 17 aa, Artificial Sequence
  Synthetic polypeptide
YIVSSGGFTSYADSVKG

SEQ ID NO: 647 - protein, 17 aa, Artificial Sequence
  Synthetic polypeptide
VIYSSGGYTDYADSVKG

SEQ ID NO: 648 - protein, 17 aa, Artificial Sequence
  Synthetic polypeptide
GIYSSGGYTKYADSVKG

SEQ ID NO: 649 - protein, 17 aa, Artificial Sequence
  Synthetic polypeptide
SIYPSGGMTDYADSVKG

SEQ ID NO: 650 - protein, 17 aa, Artificial Sequence
  Synthetic polypeptide
YIYPSGGGTDYADSVKG

SEQ ID NO: 651 - protein, 17 aa, Artificial Sequence
  Synthetic polypeptide
VIYPSGGPTSYADSVKG

SEQ ID NO: 652 - protein, 17 aa, Artificial Sequence
  Synthetic polypeptide
RISSSGGMTIYADSVKG

SEQ ID NO: 653 - protein, 17 aa, Artificial Sequence
  Synthetic polypeptide
GISSSGGVTIYADSVKG

SEQ ID NO: 654 - protein, 17 aa, Artificial Sequence
  Synthetic polypeptide
GISPSGGYTQYADSVKG

SEQ ID NO: 655 - protein, 17 aa, Artificial Sequence
  Synthetic polypeptide
GIYSSGGYTQYADSVKG

SEQ ID NO: 656 - protein, 17 aa, Artificial Sequence
  Synthetic polypeptide
SIVPSGGHTLYADSVKG

SEQ ID NO: 657 - protein, 17 aa, Artificial Sequence
  Synthetic polypeptide
VISSSGGNTAYADSVKG

SEQ ID NO: 658 - protein, 17 aa, Artificial Sequence
  Synthetic polypeptide
SIGSSGGPTPYADSVKG

SEQ ID NO: 659 - protein, 17 aa, Artificial Sequence
  Synthetic polypeptide
VIYPSGGDTFYADSVKG

SEQ ID NO: 660 - protein, 17 aa, Artificial Sequence
  Synthetic polypeptide
GISPSGGFTFYADSVKG

SEQ ID NO: 661 - protein, 17 aa, Artificial Sequence
  Synthetic polypeptide
SISSSGGSTQYADSVKG

SEQ ID NO: 662 - protein, 17 aa, Artificial Sequence
  Synthetic polypeptide
SIYPSGGYTSYADSVKG

SEQ ID NO: 663 - protein, 17 aa, Artificial Sequence
  Synthetic polypeptide
GISPSGGQTMYADSVKG

SEQ ID NO: 664 - protein, 17 aa, Artificial Sequence
  Synthetic polypeptide
YISSSGGFTSYADSVKG

SEQ ID NO: 665 - protein, 17 aa, Artificial Sequence
  Synthetic polypeptide
WIYPSGGWTEYADSVKG

SEQ ID NO: 666 - protein, 17 aa, Artificial Sequence
  Synthetic polypeptide
YIYPSGGPTKYADSVKG

SEQ ID NO: 667 - protein, 17 aa, Artificial Sequence
  Synthetic polypeptide
GIYPSGGFTMYADSVKG

SEQ ID NO: 668 - protein, 17 aa, Artificial Sequence
  Synthetic polypeptide
GIRSSGGGTRYADSVKG

SEQ ID NO: 669 - protein, 10 aa, Artificial Sequence
  Synthetic polypeptide
VSTAVADNDY

SEQ ID NO: 670 - protein, 12 aa, Artificial Sequence
  Synthetic polypeptide
DDYGGKGGAFDI

SEQ ID NO: 671 - protein, 10 aa, Artificial Sequence
  Synthetic polypeptide
VSTAVADNDY

SEQ ID NO: 672 - protein, 11 aa, Artificial Sequence
  Synthetic polypeptide
EMATIAGQFDP

SEQ ID NO: 673 - protein, 11 aa, Artificial Sequence
  Synthetic polypeptide
DAVGIGDAFDI

SEQ ID NO: 674 - protein, 12 aa, Artificial Sequence
  Synthetic polypeptide
LFYGSGSVGFEY

SEQ ID NO: 675 - protein, 9 aa, Artificial Sequence
  Synthetic polypeptide
DLDLGILDY

SEQ ID NO: 676 - protein, 10 aa, Artificial Sequence
  Synthetic polypeptide
DSYSSSWFDI

SEQ ID NO: 677 - protein, 10 aa, Artificial Sequence
  Synthetic polypeptide
SFSGFGEIDY

SEQ ID NO: 678 - protein, 12 aa, Artificial Sequence
  Synthetic polypeptide
DDEIAAGGAFDI

SEQ ID NO: 679 - protein, 10 aa, Artificial Sequence
  Synthetic polypeptide
EVAGTYAFDI

SEQ ID NO: 680 - protein, 11 aa, Artificial Sequence
  Synthetic polypeptide
GNSSSFDAFDI

SEQ ID NO: 681 - protein, 10 aa, Artificial Sequence
  Synthetic polypeptide
VDYTGDGLGY

SEQ ID NO: 682 - protein, 11 aa, Artificial Sequence
  Synthetic polypeptide
EVGAAGFAFDI

SEQ ID NO: 683 - protein, 11 aa, Artificial Sequence
  Synthetic polypeptide
GSPWGDDAFDI

SEQ ID NO: 684 - protein, 10 aa, Artificial Sequence
  Synthetic polypeptide
DQVAAAAIDY

SEQ ID NO: 685 - protein, 11 aa, Artificial Sequence
  Synthetic polypeptide
ASGSYLDAFDI

SEQ ID NO: 686 - protein, 9 aa, Artificial Sequence
  Synthetic polypeptide
DDWNVGMDV

SEQ ID NO: 687 - protein, 9 aa, Artificial Sequence
  Synthetic polypeptide
QGLLTAFDI

SEQ ID NO: 688 - protein, 10 aa, Artificial Sequence
  Synthetic polypeptide
VDTAMAMIDY

SEQ ID NO: 689 - protein, 11 aa, Artificial Sequence
  Synthetic polypeptide
GTVGASDAFDI

SEQ ID NO: 690 - protein, 13 aa, Artificial Sequence
  Synthetic polypeptide
DPGVSYYYYGMDV

SEQ ID NO: 691 - protein, 11 aa, Artificial Sequence
  Synthetic polypeptide
TYDSSAGEVDY

SEQ ID NO: 692 - protein, 12 aa, Artificial Sequence
  Synthetic polypeptide
DDYGGKGGAFDI

SEQ ID NO: 693 - protein, 8 aa, Artificial Sequence
  Synthetic polypeptide
DTDYGMDV

SEQ ID NO: 694 - protein, 10 aa, Artificial Sequence
  Synthetic polypeptide
TSITTVGMDV

SEQ ID NO: 695 - protein, 10 aa, Artificial Sequence
  Synthetic polypeptide
VAGSSDAFDI

SEQ ID NO: 696 - protein, 5 aa, Artificial Sequence
  Synthetic polypeptide
GYLGY

SEQ ID NO: 697 - protein, 10 aa, Artificial Sequence
  Synthetic polypeptide
EYPSTYYFDY

SEQ ID NO: 698 - protein, 15 aa, Artificial Sequence
  Synthetic polypeptide
DIYYYNWGPSHYFDS

SEQ ID NO: 699 - protein, 12 aa, Artificial Sequence
  Synthetic polypeptide
DGYYDSSGYPDY

SEQ ID NO: 700 - protein, 11 aa, Artificial Sequence
  Synthetic polypeptide
GSYSDYGVFES

SEQ ID NO: 701 - protein, 10 aa, Artificial Sequence
  Synthetic polypeptide
EQPGIAALQF

SEQ ID NO: 702 - protein, 12 aa, Artificial Sequence
  Synthetic polypeptide
ITTVTTGGAFDI

SEQ ID NO: 703 - protein, 10 aa, Artificial Sequence
  Synthetic polypeptide
LGGPLDAFDI

SEQ ID NO: 704 - protein, 11 aa, Artificial Sequence
  Synthetic polypeptide
GGWLAGGELLN

SEQ ID NO: 705 - protein, 12 aa, Artificial Sequence
  Synthetic polypeptide
DTGFWSADAFDI

SEQ ID NO: 706 - protein, 9 aa, Artificial Sequence
  Synthetic polypeptide
EEQQGGFDY

SEQ ID NO: 707 - protein, 11 aa, Artificial Sequence
  Synthetic polypeptide
TTVTTGDAFDI

SEQ ID NO: 708 - protein, 9 aa, Artificial Sequence
  Synthetic polypeptide
DPLYSSGDV

SEQ ID NO: 709 - protein, 11 aa, Artificial Sequence
  Synthetic polypeptide
MNLGGGDAFDI

SEQ ID NO: 710 - protein, 16 aa, Artificial Sequence
  Synthetic polypeptide
DLKWGGRGSPDWYFDL

SEQ ID NO: 711 - protein, 11 aa, Artificial Sequence
  Synthetic polypeptide
DTSGSYLGFDY

SEQ ID NO: 712 - protein, 11 aa, Artificial Sequence
  Synthetic polypeptide
APWFGELGMDV

SEQ ID NO: 713 - protein, 11 aa, Artificial Sequence
  Synthetic polypeptide
GWAPGGDAFDI

SEQ ID NO: 714 - protein, 12 aa, Artificial Sequence
  Synthetic polypeptide
SADTAMGGAFDI

SEQ ID NO: 715 - protein, 13 aa, Artificial Sequence
  Synthetic polypeptide
DRSSGWYYYGMDV

SEQ ID NO: 716 - protein, 10 aa, Artificial Sequence
  Synthetic polypeptide
LVAGLDAFDI

SEQ ID NO: 717 - protein, 11 aa, Artificial Sequence
  Synthetic polypeptide
EYGDYGGGFDP

SEQ ID NO: 718 - protein, 13 aa, Artificial Sequence
  Synthetic polypeptide
DGYHYGDYTYFQH

SEQ ID NO: 719 - protein, 10 aa, Artificial Sequence
  Synthetic polypeptide
EYPSTYYFDY

SEQ ID NO: 720 - protein, 10 aa, Artificial Sequence
  Synthetic polypeptide
EAISSSSFDY

SEQ ID NO: 721 - protein, 10 aa, Artificial Sequence
  Synthetic polypeptide
WAGWIAAADY

SEQ ID NO: 722 - protein, 10 aa, Artificial Sequence
  Synthetic polypeptide
HNWNDGAFDI

SEQ ID NO: 723 - protein, 11 aa, Artificial Sequence
  Synthetic polypeptide
DLSNGDDVFDI

SEQ ID NO: 724 - protein, 11 aa, Artificial Sequence
  Synthetic polypeptide
GSPWGDDAFDI

SEQ ID NO: 725 - protein, 11 aa, Artificial Sequence
  Synthetic polypeptide
SSGWLGDAFDI

SEQ ID NO: 726 - protein, 11 aa, Artificial Sequence
  Synthetic polypeptide
DGSGSYLGFDY

SEQ ID NO: 727 - protein, 9 aa, Artificial Sequence
  Synthetic polypeptide
DDWNVGMDV

SEQ ID NO: 728 - protein, 15 aa, Artificial Sequence
  Synthetic polypeptide
TYYYDSSGYADAFDI

SEQ ID NO: 729 - protein, 9 aa, Artificial Sequence
  Synthetic polypeptide
PGGLDAFDI

SEQ ID NO: 730 - protein, 10 aa, Artificial Sequence
  Synthetic polypeptide
ELEGLGGFDY

SEQ ID NO: 731 - protein, 13 aa, Artificial Sequence
  Synthetic polypeptide
DHLSSWYGGFFDY

SEQ ID NO: 732 - protein, 10 aa, Artificial Sequence
  Synthetic polypeptide
ESSGLYYFDY

SEQ ID NO: 733 - protein, 10 aa, Artificial Sequence
  Synthetic polypeptide
WADYGGSLDY

SEQ ID NO: 734 - protein, 11 aa, Artificial Sequence
  Synthetic polypeptide
GDDYLWEAAVY

SEQ ID NO: 735 - protein, 14 aa, Artificial Sequence
  Synthetic polypeptide
DYYYDSSGYSPLGY

SEQ ID NO: 736 - protein, 10 aa, Artificial Sequence
  Synthetic polypeptide
DRVDLGYLDY

SEQ ID NO: 737 - protein, 10 aa, Artificial Sequence
  Synthetic polypeptide
VSTAVADNDY

SEQ ID NO: 738 - protein, 9 aa, Artificial Sequence
  Synthetic polypeptide
QPMISAFDI

SEQ ID NO: 739 - protein, 10 aa, Artificial Sequence
  Synthetic polypeptide
YRVGVAATDY

SEQ ID NO: 740 - protein, 10 aa, Artificial Sequence
  Synthetic polypeptide
DAPGVGAIDY

SEQ ID NO: 741 - protein, 11 aa, Artificial Sequence
  Synthetic polypeptide
PSGSYGDAFDI

SEQ ID NO: 742 - protein, 10 aa, Artificial Sequence
  Synthetic polypeptide
ESSGVAAPDY

SEQ ID NO: 743 - protein, 18 aa, Artificial Sequence
  Synthetic polypeptide
DGSRYSYGSIYYYYGMDA

SEQ ID NO: 744 - protein, 109 aa, Artificial Sequence
  Synthetic polypeptide
QDIQMTQSPSSLSASVGDSVTISCRASQSISMYLNWYQHKPGKAPKLLIYGTSSLQSGVPSRFSGSGPGGTDFTLTISSLQPEDFATYYCQQSYSAPWTFGQGTKVEIK

SEQ ID NO: 745 - protein, 136 aa, Artificial Sequence
  Synthetic polypeptide
EVQLLESGGGLVQPGGSLRLSCAASGFTFSLYQMTWVRQAPGKGLEWVSGIWPSGGFTDYADSVKGRFTISRDNSKNTLYLQMNSLRAEDTAVYYCARVSTAVADNDYWGQGTLVTVSSASTKGPSVFPLAPSSKS

SEQ ID NO: 746 - protein, 108 aa, Artificial Sequence
  Synthetic polypeptide
QDIQMTQSPSSLSASVGDRVTITCRASQRISFYLNWFQQKPGKAPNLLIYGASSLQSGVPSRFSGSGSGTDFTLTISSLQPKDFGTYYCQQTFSTPNTFGQGTKLEIK

SEQ ID NO: 747 - protein, 138 aa, Artificial Sequence
  Synthetic polypeptide
EVQLLESGGGLVQPGGSLRLSCAASGFTFSPYPMQWVRQAPGKGLEWVSSISSSGGMTEYADSVKGRFTISRDNSKNTLYLQMNSLRAEDTAVYYCARDDYGGKGGAFDIWGQGTMVTVSSASTKGPSVFPLAPSSKS

SEQ ID NO: 748 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 749 - protein, 136 aa, Artificial Sequence
  Synthetic polypeptide
EVQLLESGGGLVQPGGSLRLSCAASGFTFSKYFMGWVRQAPGKGLEWVSVIGSSGGWTSYADSVKGRFTISRDNSKNTLYLQMNSLRAEDTAVYYCARVSTAVADNDYWGQGTLVTVSSASTKGPSVFPLAPSSKS

SEQ ID NO: 750 - protein, 107 aa, Artificial Sequence
  Synthetic polypeptide
QDIQMTQSPSSLSASVGDRVTITCRASQSISSYLNWYQQKPGKAPKLLIYGASSLQSGVPSRFSGSGSGTDFTLTISSLQPEDSATYYCQQSYTRWTFGQGTKVEIK

SEQ ID NO: 751 - protein, 137 aa, Artificial Sequence
  Synthetic polypeptide
EVQLLESGGGLVQPGGSLRLSCAASGFTFSRYHMVWVRQAPGKGLEWVSSISPSGGWTNYADSVKGRFTISRDNSKNTLYLQMNSLRAEDTAMYYCAREMATIAGQFDPWGQGTLVTVSSASTKGPSVFPLAPSSKS

SEQ ID NO: 752 - protein, 108 aa, Artificial Sequence
  Synthetic polypeptide
QDIQMTQSPSSLSASVGDRVTITCRASQSISTYLNWYQLKPGKAPKLLIYNAFSMERGVPSTISGSGSGTDFTLTISSLQPEDFATYYCQQSYTTPTTFGQGTKVEIK

SEQ ID NO: 753 - protein, 137 aa, Artificial Sequence
  Synthetic polypeptide
EVQLLESGGGLVQPGGSLRLSCAASGFTFSRYRMVWVRQAPGKGLEWVSSIYPSGGMTAYADSVKGRFTISRDNSKNTLYLQMNSLRAEDTAVYYCARDAVGIGDAFDIWGQGTMVTVSSASTKGPSVFPLAPSSKS

SEQ ID NO: 754 - protein, 105 aa, Artificial Sequence
  Synthetic polypeptide
QSALTQPPSVSVSPGQTASITCSGDKLGDKYTSWHQQKPGQSPVLVIYQDSKRPSGIPERFSGSNSGNTATLTISGTQAMDEADYYCQAWDSSTVFGGGTRLTVL

SEQ ID NO: 755 - protein, 138 aa, Artificial Sequence
  Synthetic polypeptide
EVQLLESGGGLVQPGGSLRLSCAASGFTFSYYPMQWVRQAPGKGLEWVSYIYPSGGLTSYADSVKGRFTISRDNSKNTLYLQMNSLRAEDTAVYYCARLFYGSGSVGFEYWGQGTLVTVSSASTKGPSVFPLAPSSKS

SEQ ID NO: 756 - protein, 108 aa, Artificial Sequence
  Synthetic polypeptide
QDIQMTQSPSFVSASVGDRVTITCRASQDISSWLVWYQQKPGKGPKLLIYDASNLQSGVPSRFSGGGSGTHFTLTISSLQPEDFATYYCQQADGFPLTFGGGTKVEMK

SEQ ID NO: 757 - protein, 135 aa, Artificial Sequence
  Synthetic polypeptide
EVQLLESGGGLVQPGGSLRLSCAASGFTFSLYNMNWVRQAPGKGLEWVSSISPSGGFTDYADSVKGRFTISRDNSKNTLYLQMNSLRAEDTAVYYCARDLDLGILDYWGQGTLVTVSSASTKGPSVFPLAPSSKS

SEQ ID NO: 758 - protein, 109 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLMYTFGQGTKLEIK

SEQ ID NO: 759 - protein, 136 aa, Artificial Sequence
  Synthetic polypeptide
EVQLLESGGGLVQPGGSLRLSCAASGFTFSHYFMTWVRQAPGKGLEWVSSIVPSGGMTQYADSVKGRFTISRDNSKNTLYLQMNSLRAEDTAVYYCARDSYSSSWFDIWGQGTMVTVSSASTKGPSVFPLAPSSKS

SEQ ID NO: 760 - protein, 108 aa, Artificial Sequence
  Synthetic polypeptide
QDIQMTQSPSSLSASVGDTVTITCRASQGVSYYLAWFQQKPGKAPKSLIYGASSLQSGVPSKFSGSGSGTVFTLTISSLQPDDFATYYCQQYNTYPPTFGQGTRLDIK

SEQ ID NO: 761 - protein, 136 aa, Artificial Sequence
  Synthetic polypeptide
EVQLLESGGGLVQPGGSLRLSCAASGFTFSLYEMLWVRQAPGKGLEWVSVIYPSGGYTDYADSVKGRFTISRDNSKNTLYLQMNSLRAEDMAVYYCARSFSGFGEIDYWGQGTLVTVSSASTKGPSVFPLAPSSKS

SEQ ID NO: 762 - protein, 108 aa, Artificial Sequence
  Synthetic polypeptide
QDIQMTQSPSSLSASIGDRVTITCRASQYISTYLNWYEQKPGKAPKLLIYGTSSLQSGVPSRFSGSGSGTEFSLTISSLQPEDFATYYCQQSFTTPFTFGQGTKLEIK

SEQ ID NO: 763 - protein, 138 aa, Artificial Sequence
  Synthetic polypeptide
EVQLLESGGGLVQPGGSLRLSCAASGFTFSGYWMGWVRQAPGKGLEWVSSISSSGGWTQYADSVKGRFTISRDNSKNTLYLQMNSLRAEDTATYYCARDDEIAAGGAFDIWGQGAMVTVSSASTKGPSVFPLAPSSKS

SEQ ID NO: 764 - protein, 107 aa, Artificial Sequence
  Synthetic polypeptide
QDIQMTQSPSSLSASLGDRVTITCRASQNIDIYLNWYQQTPGKAPKLLIYGAYNLQSGVPSRFSGSGSGTDFTLTISSLQPEDFGTYYCQQSYGTPVFGQGTKLEIK

SEQ ID NO: 765 - protein, 136 aa, Artificial Sequence
  Synthetic polypeptide
EVQLLESGGGLVQPGGSLRLSCAASGFTFSGYFMMWVRQAPGKGLEWVSSIYSSGGYTDYADSVKGRFTISRDNSKNTLYLQMNSLRAEDTAVYYCAREVAGTYAFDIWGQGTMVTVSSASTKGPSVFPLAPSSKS

SEQ ID NO: 766 - protein, 108 aa, Artificial Sequence
  Synthetic polypeptide
QDIQMTQSPSSLSASVGDRVTVTCRASQRISTYLNWYQQKPGKAPKLLISGASSLQSGVPSRFSGSGSGTDFTLTISSLQPDDFATYYCQQSYNTPRTFGQGTKVEIR

SEQ ID NO: 767 - protein, 137 aa, Artificial Sequence
  Synthetic polypeptide
EVQLLESGGGLVQPGGSLRLSCAASGFTFSAYEMWWVRQAPGKGLEWVSYIGSSGGSTSYADSVKGRFTISRDNSKNTLYLQMNSLRAEDTAVYYCTGGNSSSFDAFDIWGQGTMVTVSSASTKGPSVFPLAPSSKS

SEQ ID NO: 768 - protein, 108 aa, Artificial Sequence
  Synthetic polypeptide
QDIQMTQSPSSLSASVGDRVTITCRASQSISIYVNWYQQKPGKAPNLLIFAASSLQRGVPSRFSGSGSGADFTLTISSLQPEDFATYYCQQSFSTPLTFGGGTKVEIK

SEQ ID NO: 769 - protein, 136 aa, Artificial Sequence
  Synthetic polypeptide
EVQLLESGGGLVQPGGSLRLSCAASGFTFSHYGMVWVRQAPGKGLEWVSYIVPSGGLTYYADSVKGRFTISRDNSKNTLYLQMNSLRAEDTAVYYCARVDYTGDGLGYWGQGTLVTVSSASTKGPSVFPLAPSSKS

SEQ ID NO: 770 - protein, 108 aa, Artificial Sequence
  Synthetic polypeptide
QDIQMTQSPSSLSASVGDRVTITCRASQGISSYLNWYQQKPGNAPNLLIYGASSLQSGVPSRFSGSGSGTDFTLTISSLQPEDFATYYCQESYSTLFTFGPGTTVEIK

SEQ ID NO: 771 - protein, 137 aa, Artificial Sequence
  Synthetic polypeptide
EVQLLESGGGLVQPGGSLRLSCAASGFTFSLYPMQWVRQAPGKGLEWVSSIGSSGGMTFYADSVKGRFTISRDNSKNTLYLQMNSLRAEDTAVYYCTREVGAAGFAFDIWGQGTMVTVSSASTKGPSVFPLAPSSKS

SEQ ID NO: 772 - protein, 108 aa, Artificial Sequence
  Synthetic polypeptide
QDIQMTQSPSSLSASVGDRVTLTCRASRTISFYLNWYQQKAGKAPELLIYGGSSLHSGVPSRFSGSGSGTDFSLTISNLQPEDIAVYYCQQSFSSPWTFGQGTKVEIK

SEQ ID NO: 773 - protein, 137 aa, Artificial Sequence
  Synthetic polypeptide
EVQLLESGGGLVQPGGSLRLSCAASGFTFSWYKMMWVRQAPGKGLEWVSSIYPSGGWTNYADSVKGRFTISRDNSKNTLYLQMNSLRAEDTAVYYCTRGSPWGDDAFDIWGQGTMVTVSSASTKGPSVFPLAPSSKS

SEQ ID NO: 774 - protein, 108 aa, Artificial Sequence
  Synthetic polypeptide
QDIQMIQSPSSLSASVGDRVTITCRASQSISGYLNWYQQRSGKAPKLLIFAASNLQTGVPSRFSGSGSGTDFTLTINNLQPEDFATYYCQQSHTPPKTFGPGTKVDIK

SEQ ID NO: 775 - protein, 136 aa, Artificial Sequence
  Synthetic polypeptide
EVQLLESGGGLVQPGGSLRLSCAASGFTFSEYDMMWVRQAPGKGLEWVSSIGSSGGMTYYADSVKGRFTISRDNSKNTLYLQMNSLRAEDTAVYYCARDQVAAAAIDYWGQGTLVTVSSASTKGPSVFPLAPSSKS

SEQ ID NO: 776 - protein, 109 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPYTFGQGTKLEIK

SEQ ID NO: 777 - protein, 137 aa, Artificial Sequence
  Synthetic polypeptide
EVQLLESGGGLVQPGGSLRLSCAASGFTFSPYAMTWVRQAPGKGLEWVSVIYPSGGFTDYADSVKGRFTISRDNSKNTLYLQMNSLRAEDTAMYYCARASGSYLDAFDIWGQGTMVTVSSASTKGPSVFPLAPSSKS

SEQ ID NO: 778 - protein, 108 aa, Artificial Sequence
  Synthetic polypeptide
QDIQMTQSPSSLSASVGDRVTITCRASQSISSYLNWYQQKPGKAPKLLIYAASSLQSGVPSKFSGSGSGTDYTLTISSLQPEDFATYYCQQTYTTPWTFGQGTKVEIK

SEQ ID NO: 779 - protein, 135 aa, Artificial Sequence
  Synthetic polypeptide
EVQLLESGGGLVQPGGSLRLSCAASGFTFSSYPMGWVRQAPGKGLEWVSRISSSGGMTIYADSVKGRFTISRDNSKNTLYLQMNSLRAEDTAVYYCARDDWNVGMDVWGQGTTVTVSSASTKGPSVFPLAPSSKS

SEQ ID NO: 780 - protein, 108 aa, Artificial Sequence
  Synthetic polypeptide
QDIQMTQSPSSLSASVGDRVTITCRASQSINTYLNWYQQKPGKAPKVLIHAASTLESGVPSRFSGSGSGTDFTLTISSLQPEDFATYYCQQSYSTPYTFGQGTKLEVR

SEQ ID NO: 781 - protein, 135 aa, Artificial Sequence
  Synthetic polypeptide
EVQLLESGGGLVQPGGSLRLSCAASGFTFSDYDMEWVRQAPGKGLEWVSSISPSGGSTIYADSVKGRFTISRDNSKNTLYLQMNSLRAEDTAVYYCARQGLLTAFDIWGQGTMVTVSSASTKGPSVFPLAPSSKS

SEQ ID NO: 782 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGGGTKVEIK

SEQ ID NO: 783 - protein, 136 aa, Artificial Sequence
  Synthetic polypeptide
EVQLLESGGGLVQPGGSLRLSCAASGFTFSYYTMLWVRQAPGKGLEWVSSIYPSGGFTMYADSVKGRFTISRDNSKNTLYLQMNSLRAEDTAVYYCARVDTAMAMIDYWGQGTLVTVSSASTKGPSVFPLAPSSKS

SEQ ID NO: 784 - protein, 108 aa, Artificial Sequence
  Synthetic polypeptide
QDIQMTQSPSSLSASVGDRVIITCRASRSIATYLNWYQQKPGKAPNLLIFGASTLQSGVPSRFSGSGSGTDFTLTISDLQPEDFATYYCQQSFSDPYTFGQGTNLEMK

SEQ ID NO: 785 - protein, 137 aa, Artificial Sequence
  Synthetic polypeptide
EVQLLESGGGLVQPGGSLRLSCAASGFTFSAYMMIWVRQAPGKGLEWVSVIYPSGGVTMYADSVKGRFTISRDNSKNTLYLQMNSLRAEDTAVYYCARGTVGASDAFDIWGQGTMVTVSSASTKGPSVFPLAPSSKS

SEQ ID NO: 786 - protein, 106 aa, Artificial Sequence
  Synthetic polypeptide
QYELTQAPSVSVAPGQTASITCSGDKLGNRYTSWYQQKPGQSPVLVIFQDNKRPSGIPERFSGSNSGNTATLTISGTQAMDEADYYCQALDSNTYVFGTGTKVTVL

SEQ ID NO: 787 - protein, 139 aa, Artificial Sequence
  Synthetic polypeptide
EVQLLESGGGLVQPGGSLRLSCAASGFTFSWYSMGWVRQAPGKGLEWVSYIVPSGGYTMYADSVKGRFTISRDNSKNTLYLQMNSLRAEDTAVYYCARDPGVSYYYYGMDVWGQGTTVTVSSASTKGPSVFPLAPSSKS

SEQ ID NO: 788 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTRLEIK

SEQ ID NO: 789 - protein, 137 aa, Artificial Sequence
  Synthetic polypeptide
EVQLLESGGGLVQPGGSLRLSCAASGFTFSAYTMWWVRQAPGKGLEWVSSIWPSGGSTFYADSVKGRFTISRDNSKNTLYLQMNSLRAEDTAVYYCARTYDSSAGEVDYWGQGTLVTVSSASTKGPSVFPLAPSSKS

SEQ ID NO: 790 - protein, 108 aa, Artificial Sequence; identical to SEQ ID NO: 746
  Synthetic polypeptide

SEQ ID NO: 791 - protein, 138 aa, Artificial Sequence; identical to SEQ ID NO: 747
  Synthetic polypeptide

SEQ ID NO: 792 - protein, 108 aa, Artificial Sequence
  Synthetic polypeptide
QDIQMTQSPLSLSAFVGDRVTITCRASRDISVYLNWYQLKSGKAPKLLIYGASSLQSGVPSRFSGSGSGTDFTLTITSLQPEDFATYYCQQSYSIPFTFGGGTKVETK

SEQ ID NO: 793 - protein, 134 aa, Artificial Sequence
  Synthetic polypeptide
EVQLLESGGGLVQPGGSLRLSCAASGFTFSLYLMHWVRQAPGKGLEWVSSIYSSGGFTTYADSVKGRFTISRDNSKNTLYLQMNSLRAEDTAVYYCARDTDYGMDVWGQGTTVTVSSASTKGPSVFPLAPSSKS

SEQ ID NO: 794 - protein, 108 aa, Artificial Sequence
  Synthetic polypeptide
QDIQMTQSPSSLSASVGDGVTITCRASQSISTYLNWYQQRPGKAPKLLIYGASSLQSGVPSRFSGSGSGTDFTLTISSLQREDFATYYCQQSFSTPWTFGQGTRVEIK

SEQ ID NO: 795 - protein, 136 aa, Artificial Sequence
  Synthetic polypeptide
EVQLLESGGGLVQPGGSLRLSCAASGFTFSWYEMSWVRQAPGKGLEWVSRIWPSGGVTMYADSVKGRFTISRDNSKNTLYLQMNSLRAEDTAVYYCTRTSITTVGMDVWGQGTTVTVSSASTKGPSVFPLAPSSKS

SEQ ID NO: 796 - protein, 108 aa, Artificial Sequence
  Synthetic polypeptide
QDIQMTQSPSSLSASVGDRVTITCRASQSISIYLNWYQQKPEKAPKLLIFAASTLQSGVPSRFSGSGSGTDFTLTISNLQPEDFATYYCQQSHSIPPTFGLGTKVEVK

SEQ ID NO: 797 - protein, 136 aa, Artificial Sequence
  Synthetic polypeptide
EVQLLESGGGLVQPGGSLRLSCAASGFTFSMYPMMWVRQAPGKGLEWVSYISPSGGMTDYADSVKGRFTISRDNSKNTLYLQMNSLRAEDMAVYYCARVAGSSDAFDIWGQGTMVTVSSASTKGPSVFPLAPSSKS

SEQ ID NO: 798 - protein, 113 aa, Artificial Sequence
  Synthetic polypeptide
QDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGPGTKVHIK

SEQ ID NO: 799 - protein, 131 aa, Artificial Sequence
  Synthetic polypeptide
EVQLLESGGGLVQPGGSLRLSCAASGFTFSAYPMNWVRQAPGKGLEWVSRISSSGGNTSYADSVKGRFTISRDNSKNTLYLQMNSLRAEDTAVYYCALGYLGYWGQGTLVTVSSASTKGPSVFPLAPSSKS

SEQ ID NO: 800 - protein, 108 aa, Artificial Sequence
  Synthetic polypeptide
QDIQMTQSPSSLSASVGDRVTITCRASQSISTYLNWYQQKPGKAPKLLIYGASSLQSGVPSRFSGSGSGTDFTLTISSLQPEDFTIYYCQQSYSDPYTFGQGTKLDIK

SEQ ID NO: 801 - protein, 136 aa, Artificial Sequence
  Synthetic polypeptide
EVQLLESGGGLVQPGGSLRLSCAASGFTFSLYRMFWVRQAPGKGLEWVSSIWSSGGPTMYADSVKGRFTISRDNSKNTLYLQMNSLRAEDTAVYYCAREYPSTYYFDYWGQGTLVTVSSASTKGPSVFPLAPSSKS

SEQ ID NO: 802 - protein, 108 aa, Artificial Sequence
  Synthetic polypeptide
QDIQMTQSPSSLSASVGDRVTITCRASQTIDDDLIWYQQKPGRAPKLLIYAASSLQSGVPSRFSGSGSGTDFTLTITSLQPEDFATYYCQQSYNIPRTFGQGTKLESK

SEQ ID NO: 803 - protein, 141 aa, Artificial Sequence
  Synthetic polypeptide
EVQLLESGGGLVQPGGSLRLSCAASGFTFSNYDMMWVRQAPGKGLEWVSYISPSGGFTRYADSVKGRFTISRDNSKNTLYLQMNSLRAEDTATYYCAKDIYYYNWGPSHYFDSWGQGTLVTVSSASTKGPSVFPLAPSSKS

SEQ ID NO: 804 - protein, 108 aa, Artificial Sequence
  Synthetic polypeptide
QDIQMTQSPSSLSASVGDSVTITCRASQSISGYINWYQQKAGKAPKLLIYAASSLQSGVPSRFSGSGSGTHFTLTISSLQPEDFATYYCQQYVSYPFTFGPGTKVDIK

SEQ ID NO: 805 - protein, 138 aa, Artificial Sequence
  Synthetic polypeptide
EVQLLESGGGLVQPGGSLRLSCAASGFTFSQYGMQWVRQAPGKGLEWVSSIRSSGGATRYADSVKGRFTISRDNSKNTLYLQMNSLRAEDTAVYYCARDGYYDSSGYPDYWGQGTLVTVSSASTKGPSVFPLAPSSKS

SEQ ID NO: 806 - protein, 108 aa, Artificial Sequence
  Synthetic polypeptide
QDIQMTQSPSSLSASVGDRVAITCRASQSIDTYLNWYQQKPGKAPKLLIYDASNLEIGVPSRFSGSGSGTDFTFIINSLQPEDVATYYCQHYLYAPYSFGQGTKLEIK

SEQ ID NO: 807 - protein, 137 aa, Artificial Sequence
  Synthetic polypeptide
EVQLLESGGGLVQPGGSLRLSCAASGFTFSNYWMMWVRQAPGKGLEWVSGIGSSGGFTSYADSVKGRFTISRDNSKNTLYLQMNSLRAEDTAVYYCAKGSYSDYGVFESWGQGTLVTVSSASTKGPSVFPLAPSSKS

SEQ ID NO: 808 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 809 - protein, 136 aa, Artificial Sequence
  Synthetic polypeptide
EVQLLESGGGLVQPGGSLRLSCAASGFTFSTYEMYWVRQAPGKGLEWVSGIGSSGGMTMYADSVKGRFTISRDNSKNTLYLQMNSLRAEDTAMYYCAREQPGIAALQFWGQGTLVTVSSASTKGPSVFPLAPSSKS

SEQ ID NO: 810 - protein, 108 aa, Artificial Sequence
  Synthetic polypeptide
QDIQMTQSPSSLSASVGDRVTITCRASQSISIYLTWYQHRPGKAPNLLIYGAATLQTGVPSRFSGSGSGTDFTLTIRGLQPEDFATYYCQQTFSLPRTFGQGTKLEIK

SEQ ID NO: 811 - protein, 138 aa, Artificial Sequence
  Synthetic polypeptide
EVQLLESGGGLVQPGGSLRLSCAASGFTFSMYHMNWVRQAPGKGLEWVSGIVSSGGVTFYADSVKGRFTISRDNSKNTLYLQMNSLRAEDTAVYYCARITTVTTGGAFDIWGQGTMVTVSSASTKGPSVFPLAPSSKS

SEQ ID NO: 812 - protein, 108 aa, Artificial Sequence
  Synthetic polypeptide
QDIQMTQSPSSLSASVGDTVTITCRTSQTINNYLNWYQQRPGEAPKVLIYATHTLESGVPSRFSGSGSGTDFTLTIGSLQPEDFATYYCQQSFAFPYTFGQGTKVEIT

SEQ ID NO: 813 - protein, 135 aa, Artificial Sequence
  Synthetic polypeptide
EVQLLESGGGLVQPGGSLRLSCAASGFTFSWYTMGWVRQAPGKGLEWVSWIYFGGLTTYADSVKGRFTISRDNSKNTLYLQMNSLRAEDTAVYYCARLGGPLDAFDIWGQGTMVTVSSASTKGPSVFPLAPSSKS

SEQ ID NO: 814 - protein, 108 aa, Artificial Sequence
  Synthetic polypeptide
QDIQMTQSPSSLSASIGDRVTISCRASRGIGTYLNWYQQHAGKAPKLLIRAASSLETGVPPRFSGSGSGTDFTLTISSLQSDDFATYYCQESFTNVYNFGQGTKLEIK

SEQ ID NO: 815 - protein, 137 aa, Artificial Sequence
  Synthetic polypeptide
EVQLLESGGGLVQPGGSLRLSCAASGFTFSQYAMHWVRQAPGKGLEWVSSIYPSGGFTLYADSVKGRFTISRDNSKNTLYLQMNSLRAEDTAMYYCARGGWLAGGELLNWGQGTLVTVSSASTKGPSVFPLAPSSKS

SEQ ID NO: 816 - protein, 108 aa, Artificial Sequence
  Synthetic polypeptide
QDIQMTQSPSSLSASVGDRVTITCRTSQGINHYLNWYQQKPGKAPKILVFAASELQTGVPSRFSGTGSGTSYTLTITSLQPEDVATYYCQQTYTSPYTFGQGTKLEVK

SEQ ID NO: 817 - protein, 138 aa, Artificial Sequence
  Synthetic polypeptide
EVQLLESGGGLVQPGGSLRLSCAASGFTFSLYNMTWVRQAPGKGLEWVSYIYPSGGGTHYADSVKGRFTISRDNSKNTLYLQMNSLRAEDTAVYYCARDTGFWSADAFDIWGQGTMVTVSSASTKGPSVFPLAPSSKS

SEQ ID NO: 818 - protein, 108 aa, Artificial Sequence
  Synthetic polypeptide
QDIQMTQSPSSLSAFVGDRVSITCRASQTISVYVNWYQHKSGQAPKLLIYGASSLQSGVPSRFSGSGSGTDFTLTISSLQPEDFATYFCQQSYSIPFTFGGGTDVQIR

SEQ ID NO: 819 - protein, 135 aa, Artificial Sequence
  Synthetic polypeptide
EVQLLESGGGLVQPGGSLRLSCAASGFTFSQYPMNWVRQAPGKGLEWVSSISSSGGFTTYADSVKGRFTISRDNSKNTLYLQMNSLRAEDTAVYYCAREEQQGGFDYWGQGTLVTVSSASTKGPSVFPLAPSSKS

SEQ ID NO: 820 - protein, 108 aa, Artificial Sequence
  Synthetic polypeptide
QDIQMTQSPSSLSASVGDRVTITCRASQSISRYLNWYQQKPGKAPKLLIYAASTLETGVPSRFSGSGSGTDFTLTITTLQPEDFVIYYCQQSYSTPYTFGQGTKLEIK

SEQ ID NO: 821 - protein, 137 aa, Artificial Sequence
  Synthetic polypeptide
EVQLLESGGGLVQPGGSLRLSCAASGFTFSWYYMGWVRQAPGKGLEWVSWIVSSGGLTLYADSVKGRFTISRDNSKNTLYLQMNSLRAEDTAMYYCARTTVTTGDAFDIWGQGTMVTVSSASTKGPSVFPLAPSSKS

SEQ ID NO: 822 - protein, 108 aa, Artificial Sequence
  Synthetic polypeptide
QDIQMTQSPSSLSASVGDRVTITCRASQGIRNDLGWYQHKPGKAPKLLIYAASILQSGVPSRFSGTASGTDFTLTISSLQPEDFATYFCLQDYEYPLTFGGGTKLDIK

SEQ ID NO: 823 - protein, 135 aa, Artificial Sequence
  Synthetic polypeptide
EVQLLESGGGLVQPGGSLRLSCAASGFTFSLYSMYWVRQAPGKGLEWVSRIRPSGGGTVYADSVKGRFTISRDNSKNTLYLQMNSLRAEDTAVYYCARDPLYSSGDVWGQGTTVTVSSASTKGPSVFPLAPSSKS

SEQ ID NO: 824 - protein, 108 aa, Artificial Sequence
  Synthetic polypeptide
QDIQMTQSPSSLSASVGDRVTITCRASQSIGIYLNWYHQKPGKAPNLLIYGASSLQSGVPSRFSGSGSGTDFTLTISSLQPGDFATYYCQHSYSTPFTFGGGTKVEIK

SEQ ID NO: 825 - protein, 137 aa, Artificial Sequence
  Synthetic polypeptide
EVQLLESGGGLVQPGGSLRLSCAASGFTFSSYAMVWVRQAPGKGLEWVSSIGSSGGFTLYADSVKGRFTISRDNSKNTLYLQMNSLRAEDTAVYYCASMNLGGGDAFDIWGQGTMVTVSSASTKGPSVFPLAPSSKS

SEQ ID NO: 826 - protein, 110 aa, Artificial Sequence
  Synthetic polypeptide
QSALTQPPSVSVSPGQTASITCSGDKLGEKYVSWYQQKPGQSPVVVIYQDNKRPSGIPERFSGSNSGNTATLTISGTQAVDEADYYCQAWDSYTVVFGGGSKLTVLGQPK

SEQ ID NO: 827 - protein, 142 aa, Artificial Sequence
  Synthetic polypeptide
EVQLLESGGGLVQPGGSLRLSCAASGFTFSDYEMHWVRQAPGKGLEWVSGISPSGGKTQYADSVKGRFTISRDNSKNTLYLQMNSLRAEDTAVYYCARDLKWGGRGSPDWYFDLWGRGTLVTVSSASTKGPSVFPLAPSSKS

SEQ ID NO: 828 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 829 - protein, 137 aa, Artificial Sequence
  Synthetic polypeptide
EVQLLESGGGLVQPGGSLRLSCAASGFTFSNYPMDWVRQAPGKGLEWVSSISSSGGWTNYADSVKGRFTISRDNSKNTLYLQMNSLRAEDTAVYYCATDTSGSYLGFDYWGQGTLVTVSSASTKGPSVFPLAPSSKS

SEQ ID NO: 830 - protein, 108 aa, Artificial Sequence
  Synthetic polypeptide
QDIQMTQSPSSLSASVGDRVSITCRASQSISTYLNWYQHKPGKAPTLLIYGAFSLQSGVPSRFSGSGSGTDFALTISSLQPEDFATYYCQQSHSTPPTFGQGTRVEIK

SEQ ID NO: 831 - protein, 137 aa, Artificial Sequence
  Synthetic polypeptide
EVQLLESGGGLVQPGGSLRLSCAASGFTFSQYKMLWVRQAPGKGLEWVSGIGPSGGLTAYADSVKGRFTISRDNSKNTLYLQMNSLRAEDTAVYYCARAPWFGELGMDVWGQGTTVTVSSASTKGPSVFPLAPSSKS

SEQ ID NO: 832 - protein, 108 aa, Artificial Sequence
  Synthetic polypeptide
QDIQMTQSPSSLSASVGDRVTITCRASQSISAYLNWYQQKPGKAPQLLMYGVGSLQSGVPSRFSGSGSGTDFTLTISSLQPEDFATYFCQQGYTTPVTFGGGTKVEIK

SEQ ID NO: 833 - protein, 137 aa, Artificial Sequence
  Synthetic polypeptide
EVQLLESGGGLVQPGGSLRLSCAASGFTFSWYRMDWVRQAPGKGLEWVSSIWPSGGLTSYADSVKGRFTISRDNSKNTLYLQMNSLRAEDTAVYYCARGWAPGGDAFDIWGQGTMVTVSSASTKGPSVFPLAPSSKS

SEQ ID NO: 834 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 835 - protein, 138 aa, Artificial Sequence
  Synthetic polypeptide
EVQLLESGGGLVQPGGSLRLSCAASGFTFSDYTMWWVRQAPGKGLEWVSSISSSGGITFYADSVKGRFTISRDNSKNTLYLQMNSLRAEDTAVYYCARSADTAMGGAFDIWGQGTMVTVSSASTKGPSVFPLAPSSKS

SEQ ID NO: 836 - protein, 106 aa, Artificial Sequence
  Synthetic polypeptide
QYELTQPPAVSVSPGQTATITCSGDKLGDEYAAWYQQKPGQSPVLVIYQDRKRPSGIPERFSGSNFGNTATLTITGTQVMDEADYYCQAWGKRNVVFGGGTKLTVL

SEQ ID NO: 837 - protein, 139 aa, Artificial Sequence
  Synthetic polypeptide
EVQLLESGGGLVQPGGSLRLSCAASGFTFSWYQMMWVRQAPGKGLEWVSSISPSGGITEYADSVKGRFTISRDNSKNTLYLQMNSLRAEDTAVYYCARDRSSGWYYYGMDVWGQGTTVTVSSASTKGPSVFPLAPSSKS

SEQ ID NO: 838 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 839 - protein, 136 aa, Artificial Sequence
  Synthetic polypeptide
EVQLLESGGGLVQPGGSLRLSCAASGFTFSSYMMHWVRQAPGKGLEWVSGIYPSGGWTDYADSVKGRFTISRDNSKNTLYLQMNSLRAEDTATYYCARLVAGLDAFDIWGQGTMVTVSSASTKGPSVFPLAPSSKS

SEQ ID NO: 840 - protein, 108 aa, Artificial Sequence; identical to SEQ ID NO: 808
  Synthetic polypeptide

SEQ ID NO: 841 - protein, 137 aa, Artificial Sequence
  Synthetic polypeptide
EVQLLESGGGLVQPGGSLRLSCAASGFTFSWYPMTWVRQAPGKGLEWVSSIGPSGGQTIYADSVKGRFTISRDNSKNTLYLQMNSLRAEDTAVYYCTTEYGDYGGGFDPWGQGTLVTVSSASTKGPSVFPLAPSSKS

SEQ ID NO: 842 - protein, 108 aa, Artificial Sequence
  Synthetic polypeptide
QDIQMTQSPSFLSASVGDRVTITCRASQGISSYLAWYQQKPGKAPKLLIYAASSLQSGVPSRFSGSGSGTDFTLTISSLQPEDFATYYCQQSYNTLRTFGPGTKVDLK

SEQ ID NO: 843 - protein, 139 aa, Artificial Sequence
  Synthetic polypeptide
EVQLLESGGGLVQPGGSLRLSCAASGFTFSSYHMMWVRQAPGKGLEWVSSIYPSGGATMYADSVKGRFTISRDNSKNTLYLQMNSLRAEDTAMYYCARDGYHYGDYTYFQHWGQGTLVTVSSASTKGPSVFPLAPSSKS

SEQ ID NO: 844 - protein, 108 aa, Artificial Sequence; identical to SEQ ID NO: 800
  Synthetic polypeptide

SEQ ID NO: 845 - protein, 136 aa, Artificial Sequence; identical to SEQ ID NO: 801
  Synthetic polypeptide

SEQ ID NO: 846 - protein, 108 aa, Artificial Sequence
  Synthetic polypeptide
QDIQMTQSPSSLSASVGDRVTITCRASQRISYYLTWYQQKPGKVPKLLIYAASSLESGVPSRFSGSGSGTDFTLTISNLQPEDFATYYCQQAFSTPFTFGGGTKVEIK

SEQ ID NO: 847 - protein, 136 aa, Artificial Sequence
  Synthetic polypeptide
EVQLLESGGGLVQPGGSLRLSCAASGFTFSAYYMVWVRQAPGKGLEWVSYISPSGGQTQYADSVKGRFTISRDNSKNTLYLQMNSLRAEDTAVYYCAREAISSSSFDYWGQGTLVTVSSASTKGPSVFPLAPSSKS

SEQ ID NO: 848 - protein, 108 aa, Artificial Sequence
  Synthetic polypeptide
QDIQMTQSPSSVSASVGDRITITCRTRQSISNYLNWYQQKPGEPPKLLIFAASSLQSGVPSRFSGSGTGTEFTLTISSLQPEDLAIYYCQQSYDIPFTFGQGTKLEIK

SEQ ID NO: 849 - protein, 136 aa, Artificial Sequence
  Synthetic polypeptide
EVQLLESGGGLVQPGGSLRLSCAASGFTFSEYDMAWVRQAPGKGLEWVSYIVSSGGFTSYADSVKGRFTISRDNSKNTLYLQMNSLRAEDTAVYYCTTWAGWIAAADYWGQGTLVTVSSASTKGPSVFPLAPSSKS

SEQ ID NO: 850 - protein, 108 aa, Artificial Sequence
  Synthetic polypeptide
QDIQMTQSPSSLSASVGDRVTITCRASQSISNYLNWYQQKPGKAPKFLIYAASSLQSGVPSRFSGSGSGTDFTLSISSLQPEDFATYYCQQSYSTPQTFGQGTKVEMK

SEQ ID NO: 851 - protein, 136 aa, Artificial Sequence
  Synthetic polypeptide
EVQLLESGGGLVQPGGSLRLSCAASGFTFSAYQMAWVRQAPGKGLEWVSVIYSSGGYTDYADSVKGRFTISRDNSKNTLYLQMNSLRAEDTAVYYCARHNWNDGAFDIWGQGTMVTVSSASTKGPSVFPLAPSSKS

SEQ ID NO: 852 - protein, 107 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 853 - protein, 137 aa, Artificial Sequence
  Synthetic polypeptide
EVQLLESGGGLVQPGGSLRLSCAASGFTFSWYAMHWVRQAPGKGLEWVSGIYSSGGYTKYADSVKGRFTISRDNSKNTLYLQMNSLRAEDTAVYYCARDLSNGDDVFDIWGQGTMVTVSSASTKGPSVFPLAPSSKS

SEQ ID NO: 854 - protein, 108 aa, Artificial Sequence
  Synthetic polypeptide
QDIQMTQSPSSLSASVGDRVTITCRASQSINFYLNWYQQKPGKAPKLLIYVASSLESGVPSRFSGSASGTEFTLTISSLQPEDFATYYCLQSYSAPYTFGQGTKVEIT

SEQ ID NO: 855 - protein, 137 aa, Artificial Sequence
  Synthetic polypeptide
EVQLLESGGGLVQPGGSLRLSCAASGFTFSYYQMGWVRQAPGKGLEWVSSIYPSGGMTDYADSVKGRFTISRDNSKNTLYLQMNSLRAEDTAVYYCTRGSPWGDDAFDIWGQGTMVTVSSASTKGPSVFPLAPSSKS

SEQ ID NO: 856 - protein, 108 aa, Artificial Sequence
  Synthetic polypeptide
QDIQMTQSPSSLSASEGDMVTITCRTSRRIGTYLNWYQQKPGKAPKLLIYGASSLQSGVPSRFSGSGSGTDFTLTVSSLQPEDVGTYYCQQSFSSPWTFGPGTKVEIK

SEQ ID NO: 857 - protein, 137 aa, Artificial Sequence
  Synthetic polypeptide
EVQLLESGGGLVQPGGSLRLSCAASGFTFSWYPMQWVRQAPGKGLEWVSYIYPSGGGTDYADSVKGRFTISRDNSKNTLYLQMNSLRAEDTATYYCATSSGWLGDAFDIWGQGTMVTVSSASTKGPSVFPLAPSSKS

SEQ ID NO: 858 - protein, 110 aa, Artificial Sequence
  Synthetic polypeptide
QDIQMTQSPSSLSASVGDRVTITCRASQSIATYLNWYQQKPGRAPKLLIYAASSLQSGVPSRFVGGGSGSGTHFTLTISSLQPEDFATYYCQQSYSTRETFGQGTKVEIK

SEQ ID NO: 859 - protein, 137 aa, Artificial Sequence
  Synthetic polypeptide
EVQLLESGGGLVQPGGSLRLSCAASGFTFSWYTMHWVRQAPGKGLEWVSVIYPSGGPTSYADSVKGRFTISRDNSKNTLYLQMNSLRAEDTATYYCARDGSGSYLGFDYWGQGTLVTVSSASTKGPSVFPLAPSSKS

SEQ ID NO: 860 - protein, 108 aa, Artificial Sequence; identical to SEQ ID NO: 778
  Synthetic polypeptide

SEQ ID NO: 861 - protein, 135 aa, Artificial Sequence; identical to SEQ ID NO: 779
  Synthetic polypeptide

SEQ ID NO: 862 - protein, 108 aa, Artificial Sequence
  Synthetic polypeptide
QDIQMTQSPSSVSASVGDRVTINCRASQDISNWLAWYQQKPGKAPNLLIYAASSLQTGAPSRFSGSGSGTDFTLTISSLQPEDFGTYVCQQSYSLPWTFGLGTKVEVR

SEQ ID NO: 863 - protein, 141 aa, Artificial Sequence
  Synthetic polypeptide
EVQLLESGGGLVQPGGSLRLSCAASGFTFSLYDMTWVRQAPGKGLEWVSGISSSGGVTIYADSVKGRFTISRDNSKNTLYLQMNSLRAEDTAVYYCARTYYYDSSGYADAFDIWGQGTMVTVSSASTKGPSVFPLAPSSKS

SEQ ID NO: 864 - protein, 108 aa, Artificial Sequence
  Synthetic polypeptide
QDIQMTQSPSSLSASVGDRVTITCRASQSINTYLNWYQQKPGKAPKVLIHAASTLESGVPSRFSGSGSGTDFTLTISSLQPEDFATYYCQQSYSTPPTFGQGTKVEIK

SEQ ID NO: 865 - protein, 135 aa, Artificial Sequence
  Synthetic polypeptide
EVQLLESGGGLVQPGGSLRLSCAASGFTFSVYLMHWVRQAPGKGLEWVSGISPSGGYTQYADSVKGRFTISRDNSKNTLYLQMNSLRAEDTAVYYCARPGGLDAFDIWGQGTMVTVSSASTKGPSVFPLAPSSKS

SEQ ID NO: 866 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 867 - protein, 136 aa, Artificial Sequence
  Synthetic polypeptide
EVQLLESGGGLVQPGGSLRLSCAASGFTFSRYIMWWVRQAPGKGLEWVSGIYSSGGYTQYADSVKGRFTISRDNSKNTLYLQMNSLRAEDTAMYYCARELEGLGGFDYWGQGTLVTVSSASTKGPSVFPLAPSSKS

SEQ ID NO: 868 - protein, 108 aa, Artificial Sequence
  Synthetic polypeptide
QDIQMTQSPSSVSASVGDRVTITCRASQGISSWLAWYQQKPGKAPKLLIYATSGLQSGVPSRFSGSGSGTDFTLTISSLQPEDFATYYCQQAKSFPLTFGGGTRVEIK

SEQ ID NO: 869 - protein, 139 aa, Artificial Sequence
  Synthetic polypeptide
EVQLLESGGGLVQPGGSLRLSCAASGFTFSDYTMYWVRQAPGKGLEWVSSIVPSGGHTLYADSVKGRFTISRDNSKNTLYLQMNSLRAEDTAVYYCAKDHLSSWYGGFFDYWGQGTLVTVSSASTKGPSVFPLAPSSKS

SEQ ID NO: 870 - protein, 108 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTRYTFGQGTKLEIK

SEQ ID NO: 871 - protein, 136 aa, Artificial Sequence
  Synthetic polypeptide
EVQLLESGGGLVQPGGSLRLSCAASGFTFSGYDMMWVRQAPGKGLEWVSVISSSGGNTAYADSVKGRFTISRDNSKNTLYLQMNSLRAEDTAVYYCARESSGLYYFDYWGQGTLVTVSSASTKGPSVFPLAPSSKS

SEQ ID NO: 872 - protein, 108 aa, Artificial Sequence
  Synthetic polypeptide
QDIQMTQSPSSLSASVGDTVSITCRASQSITIYLNWYQHKPGKAPNLLIYGASNLHSGVPSRFSGSGSGTDFTLTISSLQPEDFATYYCQQSYDTPLTFGGGTKVEIK

SEQ ID NO: 873 - protein, 136 aa, Artificial Sequence
  Synthetic polypeptide
EVQLLESGGGLVQPGGSLRLSCAASGFTFSWYPMYWVRQAPGKGLEWVSSIGSSGGPTPYADSVKGRFTISRDNSKNTLYLQMNSLRAEDTAVYYCARWADYGGSLDYWGQGTLVTVSSASTKGPSVFPLAPSSKS

SEQ ID NO: 874 - protein, 110 aa, Artificial Sequence
  Synthetic polypeptide
QSVLTQPPSVSEAPRQRVTISCSGSSSNIGNNAVSWYQQLPGKAPKLLIYYDDLLPSGVSDRFSGSKSGTSASLAISGLRSEDEADYYCAAWDDSLNGFVFGTGTKVTVL

SEQ ID NO: 875 - protein, 137 aa, Artificial Sequence
  Synthetic polypeptide
EVQLLESGGGLVQPGGSLRLSCAASGFTFSRYPMMWVRQAPGKGLEWVSVIYPSGGDTFYADSVKGRFTISRDNSKNTLYLQMNSLRAEDTAVYYCASGDDYLWEAAVYWGQGTLVTVSSASTKGPSVFPLAPSSKS

SEQ ID NO: 876 - protein, 110 aa, Artificial Sequence
  Synthetic polypeptide
QDIQMTQSPATLSASPGETVTLSCRASQNIGNDVAWYRQRPGQAPRLLIHHASTRAYGIPARLRGSGSATEFTLTITSLEPEDFAIYYCQQFYDWPAHTFALGTRLEIKR

SEQ ID NO: 877 - protein, 140 aa, Artificial Sequence
  Synthetic polypeptide
EVQLLESGGGLVQPGGSLRLSCAASGFTFSYYHMWWVRQAPGKGLEWVSGISPSGGFTFYADSVKGRFTISRDNSKNTLYLQMNSLRAEDTAVYYCARDYYYDSSGYSPLGYWGQGTLVTVSSASTKGPSVFPLAPSSKS

SEQ ID NO: 878 - protein, 108 aa, Artificial Sequence
  Synthetic polypeptide
QDIQMTQSPSSLSSSVGDSATITCRASQSISIYLNWYQQKPGKAPKILIYGASQLESGVPSRFSGSGSGTDFTLTVSGLQPEDFATYWCQQSYNVPYTFGQGTKLEIK

SEQ ID NO: 879 - protein, 136 aa, Artificial Sequence
  Synthetic polypeptide
EVQLLESGGGLVQPGGSLRLSCAASGFTFSFYKMIWVRQAPGKGLEWVSSISSSGGSTQYADSVKGRFTISRDNSKNTLYLQMNSLRAEDTAVYYCARDRVDLGYLDYWGQGTLVTVSSASTKGPSVFPLAPSSKS

SEQ ID NO: 880 - protein, 108 aa, Artificial Sequence
  Synthetic polypeptide
QDIQMTQSPSSLSASVRDRVTITCRTSQNINTYLNWYYQAPGRAPKLLIFGVSSLHRGVSSRFSGSGDGTEFTLTISSLQPEDIGTYFCQQSYSSPWTFGQGTKVEIK

SEQ ID NO: 881 - protein, 136 aa, Artificial Sequence
  Synthetic polypeptide
EVQLLESGGGLVQPGGSLRLSCAASGFTFSQYLMMWVRQAPGKGLEWVSSIYPSGGYTSYADSVKGRFTISRDNSKNTLYLQMNSLRAEDTAVYYCARVSTAVADNDYWGQGTLVTVSSASTKGPSVFPLAPSSKS

SEQ ID NO: 882 - protein, 109 aa, Artificial Sequence
  Synthetic polypeptide
QDIQMTQSPSSLSASVGDRVTITCRASQTIDNYLHWYQQKPGKAPKVLIHDASSLQSGVPPRFSGSGSGTDFTLTISSLQPEDFATYYCQQSYDTPQYTFGQGTKLEIK

SEQ ID NO: 883 - protein, 135 aa, Artificial Sequence
  Synthetic polypeptide
EVQLLESGGGLVQPGGSLRLSCAASGFTFSLYDMNWVRQAPGKGLEWVSGISPSGGQTMYADSVKGRFTISRDNSKNTLYLQMNSLRAEDTAVYYCARQPMISAFDIWGQGTMVTVSSASTKGPSVFPLAPSSKS

SEQ ID NO: 884 - protein, 109 aa, Artificial Sequence
  Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 885 - protein, 136 aa, Artificial Sequence
  Synthetic polypeptide
EVQLLESGGGLVQPGGSLRLSCAASGFTFSLYAMWWVRQAPGKGLEWVSYISSSGGFTSYADSVKGRFTISRDNSKNTLYLQMNSLRAEDTAVYYCARYRVGVAATDYWGQGTLVTVSSASTKGPSVFPLAPSSKS

SEQ ID NO: 886 - protein, 108 aa, Artificial Sequence
  Synthetic polypeptide
QDIQMTQSPSSLSASVRDRVTITCRASQSISTYLNWYQQKPGEAPKLLVFAASSLQSGVPSRFSGSGSGTDFTLSISSLQPEDFATYYCQQSYSTPHTFGQGAKVEIK

SEQ ID NO: 887 - protein, 136 aa, Artificial Sequence
  Synthetic polypeptide
EVQLLESGGGLVQPGGSLRLSCAASGFTFSGYIMHWVRQAPGKGLEWVSWIYPSGGWTEYADSVKGRFTISRDNSKNTLYLQMNSLRAEDTAVYYCARDAPGVGAIDYWGQGTLVTVSSASTKGPSVFPLAPSSKS

SEQ ID NO: 888 - protein, 108 aa, Artificial Sequence
  Synthetic polypeptide
QDIQMTQSPSSLSASEGDRVTITCRASQDISVYLNWYQMKSGKAPKLLIYGGASLQSGVPARFSGSGYGTDFTLTITDLRPEDFATYYCQQSYSLPFTFGGGTKVEIK

SEQ ID NO: 889 - protein, 137 aa, Artificial Sequence
  Synthetic polypeptide
EVQLLESGGGLVQPGGSLRLSCAASGFTFSMYWMQWVRQAPGKGLEWVSYIYPSGGPTKYADSVKGRFTISRDNSKNTLYLQMNSLRAEDTAVYYCARPSGSYGDAFDIWGQGTMVTVSSASTKGPSVFPLAPSSKS

SEQ ID NO: 890 - protein, 108 aa, Artificial Sequence
  Synthetic polypeptide
QDIQMTQSPSTLSASVGDRVTITCRASQNISSYLNWYQQKPGKAPKLLIYAASSLQSGVPSRFSGSGSGTDFTLTISSLQPEDFATYSCQQSYSTPRTFGQGTKVEIK

SEQ ID NO: 891 - protein, 136 aa, Artificial Sequence
  Synthetic polypeptide
EVQLLESGGGLVQPGGSLRLSCAASGFTFSLYIMGWVRQAPGKGLEWVSGIYPSGGFTMYADSVKGRFTISRDNSKNTLYLQMNSLRAEDTAVYYCARESSGVAAPDYWGQGTLVTVSSASTKGPSVFPLAPSSKS

SEQ ID NO: 892 - protein, 112 aa, Artificial Sequence
  Synthetic polypeptide
QDIQMTQSPLSLPVTPGEPASISCRSSQSLLHSRGYNYLDWYLQKPGQSPQLLIYLGSNRASGVPDRFSGSGSGTDFTLKISRVEAEDVGVYYCMQALQRRTFGQGTKLEIK

SEQ ID NO: 893 - protein, 144 aa, Artificial Sequence
  Synthetic polypeptide
EVQLLESGGGLVQPGGSLRLSCAASGFTFSYYTMIWVRQAPGKGLEWVSGIRSSGGGTRYADSVKGRFTISRDNSKNTLYLQMNSLRAEDTAVYYCAKDGSRYSYGSIYYYYGMDAWGQGTTVTVSSASTKGPSVFPLAPSSKS

SEQ ID NO: 894 - protein, 17 aa, Artificial Sequence
  Synthetic polypeptide
GGLLLWFRELKSNYFDY

SEQ ID NO: 895 - protein, 14 aa, Artificial Sequence
  Synthetic polypeptide
GGLLLWFRELKSNY

SEQ ID NO: 896 - DNA, 42 bp, Artificial Sequence
  Synthetic polynucleotide
  misc_feature (22)..(23): n is a, c, g, or t
ggcggtctattactatggttcnnkgagctgaagtctaactac

SEQ ID NO: 897 - DNA, 42 bp, Artificial Sequence
  Synthetic polynucleotide
  misc_feature (19)..(20): n is a, c, g, or t
ggcggtctattactatggnnkagggagctgaagtctaactac

SEQ ID NO: 898 - DNA, 42 bp, Artificial Sequence
  Synthetic polynucleotide
  misc_feature (16)..(17): n is a, c, g, or t
ggcggtctattactannkttcagggagctgaagtctaactac

SEQ ID NO: 899 - DNA, 42 bp, Artificial Sequence
  Synthetic polynucleotide
  misc_feature (25)..(26): n is a, c, g, or t
ggcggtctattactatggttcaggnnkctgaagtctaactac

SEQ ID NO: 900 - protein, 17 aa, Artificial Sequence
  Synthetic polypeptide
GGLLLWFRELKSNYFDY

SEQ ID NO: 901 - protein, 17 aa, Artificial Sequence
  Synthetic polypeptide
GGLLLAFRELKSNYFDY

SEQ ID NO: 902 - protein, 17 aa, Artificial Sequence
  Synthetic polypeptide
GGLLLCFRELKSNYFDY

SEQ ID NO: 903 - protein, 17 aa, Artificial Sequence
  Synthetic polypeptide
GGLLLDFRELKSNYFDY

SEQ ID NO: 904 - protein, 17 aa, Artificial Sequence
  Synthetic polypeptide
GGLLLEFRELKSNYFDY

SEQ ID NO: 905 - protein, 17 aa, Artificial Sequence
  Synthetic polypeptide
GGLLLGFRELKSNYFDY

SEQ ID NO: 906 - protein, 17 aa, Artificial Sequence
  Synthetic polypeptide
GGLLLKFRELKSNYFDY

SEQ ID NO: 907 - protein, 17 aa, Artificial Sequence
  Synthetic polypeptide
GGLLLLFRELKSNYFDY

SEQ ID NO: 908 - protein, 17 aa, Artificial Sequence
  Synthetic polypeptide
GGLLLMFRELKSNYFDY

SEQ ID NO: 909 - protein, 17 aa, Artificial Sequence
  Synthetic polypeptide
GGLLLPFRELKSNYFDY

SEQ ID NO: 910 - protein, 17 aa, Artificial Sequence
  Synthetic polypeptide
GGLLLQFRELKSNYFDY

SEQ ID NO: 911 - protein, 17 aa, Artificial Sequence
  Synthetic polypeptide
GGLLLRFRELKSNYFDY

SEQ ID NO: 912 - protein, 17 aa, Artificial Sequence
  Synthetic polypeptide
GGLLLSFRELKSNYFDY

SEQ ID NO: 913 - protein, 17 aa, Artificial Sequence
  Synthetic polypeptide
GGLLLTFRELKSNYFDY

SEQ ID NO: 914 - protein, 17 aa, Artificial Sequence
  Synthetic polypeptide
GGLLLVFRELKSNYFDY

SEQ ID NO: 915 - protein, 17 aa, Artificial Sequence
  Synthetic polypeptide
GGLLLWARELKSNYFDY

SEQ ID NO: 916 - protein, 17 aa, Artificial Sequence
  Synthetic polypeptide
GGLLLWCRELKSNYFDY

SEQ ID NO: 917 - protein, 17 aa, Artificial Sequence
  Synthetic polypeptide
GGLLLWDRELKSNYFDY

SEQ ID NO: 918 - protein, 17 aa, Artificial Sequence
  Synthetic polypeptide
GGLLLWERELKSNYFDY

SEQ ID NO: 919 - protein, 17 aa, Artificial Sequence
  Synthetic polypeptide
GGLLLWGRELKSNYFDY

SEQ ID NO: 920 - protein, 17 aa, Artificial Sequence
  Synthetic polypeptide
GGLLLWKRELKSNYFDY

SEQ ID NO: 921 - protein, 17 aa, Artificial Sequence
  Synthetic polypeptide
GGLLLWLRELKSNYFDY

SEQ ID NO: 922 - protein, 17 aa, Artificial Sequence
  Synthetic polypeptide
GGLLLWMRELKSNYFDY

SEQ ID NO: 923 - protein, 17 aa, Artificial Sequence
  Synthetic polypeptide
GGLLLWNRELKSNYFDY

SEQ ID NO: 924 - protein, 17 aa, Artificial Sequence
  Synthetic polypeptide
GGLLLWPRELKSNYFDY

SEQ ID NO: 925 - protein, 17 aa, Artificial Sequence
  Synthetic polypeptide
GGLLLWQRELKSNYFDY

SEQ ID NO: 926 - protein, 17 aa, Artificial Sequence
  Synthetic polypeptide
GGLLLWRRELKSNYFDY

SEQ ID NO: 927 - protein, 17 aa, Artificial Sequence
  Synthetic polypeptide
GGLLLWSRELKSNYFDY

SEQ ID NO: 928 - protein, 17 aa, Artificial Sequence
  Synthetic polypeptide
GGLLLWTRELKSNYFDY

SEQ ID NO: 929 - protein, 17 aa, Artificial Sequence
  Synthetic polypeptide
GGLLLWWRELKSNYFDY

SEQ ID NO: 930 - protein, 17 aa, Artificial Sequence
  Synthetic polypeptide
GGLLLWYRELKSNYFDY

SEQ ID NO: 931 - protein, 17 aa, Artificial Sequence
  Synthetic polypeptide
GGLLLWFAELKSNYFDY

SEQ ID NO: 932 - protein, 17 aa, Artificial Sequence
  Synthetic polypeptide
GGLLLWFCELKSNYFDY

SEQ ID NO: 933 - protein, 17 aa, Artificial Sequence
  Synthetic polypeptide
GGLLLWFEELKSNYFDY

SEQ ID NO: 934 - protein, 17 aa, Artificial Sequence
  Synthetic polypeptide
GGLLLWFFELKSNYFDY

SEQ ID NO: 935 - protein, 17 aa, Artificial Sequence
  Synthetic polypeptide
GGLLLWFGELKSNYFDY

SEQ ID NO: 936 - protein, 17 aa, Artificial Sequence
  Synthetic polypeptide
GGLLLWFHELKSNYFDY

SEQ ID NO: 937 - protein, 17 aa, Artificial Sequence
  Synthetic polypeptide
GGLLLWFKELKSNYFDY

SEQ ID NO: 938 - protein, 17 aa, Artificial Sequence
  Synthetic polypeptide
GGLLLWFLELKSNYFDY

SEQ ID NO: 939 - protein, 17 aa, Artificial Sequence
  Synthetic polypeptide
GGLLLWFMELKSNYFDY

SEQ ID NO: 940 - protein, 17 aa, Artificial Sequence
  Synthetic polypeptide
GGLLLWFPELKSNYFDY

SEQ ID NO: 941 - protein, 17 aa, Artificial Sequence
  Synthetic polypeptide
GGLLLWFQELKSNYFDY

SEQ ID NO: 942 - protein, 17 aa, Artificial Sequence
  Synthetic polypeptide
GGLLLWFSELKSNYFDY

SEQ ID NO: 943 - protein, 17 aa, Artificial Sequence
  Synthetic polypeptide
GGLLLWFTELKSNYFDY

SEQ ID NO: 944 - protein, 17 aa, Artificial Sequence
  Synthetic polypeptide
GGLLLWFVELKSNYFDY

SEQ ID NO: 945 - protein, 17 aa, Artificial Sequence
  Synthetic polypeptide
GGLLLWFWELKSNYFDY

SEQ ID NO: 946 - protein, 17 aa, Artificial Sequence
  Synthetic polypeptide
GGLLLWFYELKSNYFDY

SEQ ID NO: 947 - protein, 17 aa, Artificial Sequence
  Synthetic polypeptide
GGLLLWFRALKSNYFDY

SEQ ID NO: 948 - protein, 17 aa, Artificial Sequence
  Synthetic polypeptide
GGLLLWFRCLKSNYFDY

SEQ ID NO: 949 - protein, 17 aa, Artificial Sequence
  Synthetic polypeptide
GGLLLWFRGLKSNYFDY

SEQ ID NO: 950 - protein, 17 aa, Artificial Sequence
  Synthetic polypeptide
GGLLLWFRHLKSNYFDY

SEQ ID NO: 951 - protein, 17 aa, Artificial Sequence
  Synthetic polypeptide
GGLLLWFRKLKSNYFDY

SEQ ID NO: 952 - protein, 17 aa, Artificial Sequence
  Synthetic polypeptide
GGLLLWFRLLKSNYFDY

SEQ ID NO: 953 - protein, 17 aa, Artificial Sequence
  Synthetic polypeptide
GGLLLWFRNLKSNYFDY

SEQ ID NO: 954 - protein, 17 aa, Artificial Sequence
  Synthetic polypeptide
GGLLLWFRPLKSNYFDY

SEQ ID NO: 955 - protein, 17 aa, Artificial Sequence
  Synthetic polypeptide
GGLLLWFRQLKSNYFDY

SEQ ID NO: 956 - protein, 17 aa, Artificial Sequence
  Synthetic polypeptide
GGLLLWFRRLKSNYFDY

SEQ ID NO: 957 - protein, 17 aa, Artificial Sequence
  Synthetic polypeptide
GGLLLWFRSLKSNYFDY

SEQ ID NO: 958 - protein, 17 aa, Artificial Sequence
  Synthetic polypeptide
GGLLLWFRTLKSNYFDY

SEQ ID NO: 959 - protein, 17 aa, Artificial Sequence
  Synthetic polypeptide
GGLLLWFRVLKSNYFDY

SEQ ID NO: 960 - protein, 17 aa, Artificial Sequence
  Synthetic polypeptide
GGLLLWFRWLKSNYFDY

SEQ ID NO: 961 - protein, 17 aa, Artificial Sequence
  Synthetic polypeptide
GGLLLWFRYLKSNYFDY

SEQ ID NO: 962 - protein, 108 aa, Artificial Sequence; identical to SEQ ID NO: 260
  Synthetic polypeptide

SEQ ID NO: 963 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLAFRELKSNYFDYWGQGTLVTVSSASTKGPSVFPLAPSSKS

SEQ ID NO: 964 - protein, 108 aa, Artificial Sequence; identical to SEQ ID NO: 260
  Synthetic polypeptide

SEQ ID NO: 965 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLCFRELKSNYFDYWGQGTLVTVSSASTKGPSVFPLAPSSKS

SEQ ID NO: 966 - protein, 108 aa, Artificial Sequence; identical to SEQ ID NO: 260
  Synthetic polypeptide

SEQ ID NO: 967 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLDFRELKSNYFDYWGQGTLVTVSSASTKGPSVFPLAPSSKS

SEQ ID NO: 968 - protein, 108 aa, Artificial Sequence; identical to SEQ ID NO: 260
  Synthetic polypeptide

SEQ ID NO: 969 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLEFRELKSNYFDYWGQGTLVTVSSASTKGPSVFPLAPSSKS

SEQ ID NO: 970 - protein, 108 aa, Artificial Sequence; identical to SEQ ID NO: 260
  Synthetic polypeptide

SEQ ID NO: 971 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLGFRELKSNYFDYWGQGTLVTVSSASTKGPSVFPLAPSSKS

SEQ ID NO: 972 - protein, 108 aa, Artificial Sequence; identical to SEQ ID NO: 260
  Synthetic polypeptide

SEQ ID NO: 973 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLKFRELKSNYFDYWGQGTLVTVSSASTKGPSVFPLAPSSKS

SEQ ID NO: 974 - protein, 108 aa, Artificial Sequence; identical to SEQ ID NO: 260
  Synthetic polypeptide

SEQ ID NO: 975 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLLFRELKSNYFDYWGQGTLVTVSSASTKGPSVFPLAPSSKS

SEQ ID NO: 976 - protein, 108 aa, Artificial Sequence; identical to SEQ ID NO: 260
  Synthetic polypeptide

SEQ ID NO: 977 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLMFRELKSNYFDYWGQGTLVTVSSASTKGPSVFPLAPSSKS

SEQ ID NO: 978 - protein, 108 aa, Artificial Sequence; identical to SEQ ID NO: 260
  Synthetic polypeptide

SEQ ID NO: 979 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLPFRELKSNYFDYWGQGTLVTVSSASTKGPSVFPLAPSSKS

SEQ ID NO: 980 - protein, 108 aa, Artificial Sequence; identical to SEQ ID NO: 260
  Synthetic polypeptide

SEQ ID NO: 981 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLQFRELKSNYFDYWGQGTLVTVSSASTKGPSVFPLAPSSKS

SEQ ID NO: 982 - protein, 108 aa, Artificial Sequence; identical to SEQ ID NO: 260
  Synthetic polypeptide

SEQ ID NO: 983 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLRFRELKSNYFDYWGQGTLVTVSSASTKGPSVFPLAPSSKS

SEQ ID NO: 984 - protein, 108 aa, Artificial Sequence; identical to SEQ ID NO: 260
  Synthetic polypeptide

SEQ ID NO: 985 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNILYLQMNSLRAEDTAVYYCARGGLLLSFRELKSNYFDYWGQGTLVTVSSASTKGPSVFPLAPSSKS

SEQ ID NO: 986 - protein, 108 aa, Artificial Sequence; identical to SEQ ID NO: 260
  Synthetic polypeptide

SEQ ID NO: 987 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLTFRELKSNYFDYWGQGTLVTVSSASTKGPSVFPLAPSSKS

SEQ ID NO: 988 - protein, 108 aa, Artificial Sequence; identical to SEQ ID NO: 260
  Synthetic polypeptide

SEQ ID NO: 989 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLVFRELKSNYFDYWGQGTLVTVSSASTKGPSVFPLAPSSKS

SEQ ID NO: 990 - protein, 108 aa, Artificial Sequence; identical to SEQ ID NO: 260
  Synthetic polypeptide

SEQ ID NO: 991 - protein, 143 aa, Artificial Sequence; identical to SEQ ID NO: 291
  Synthetic polypeptide

SEQ ID NO: 992 - protein, 108 aa, Artificial Sequence; identical to SEQ ID NO: 260
  Synthetic polypeptide

SEQ ID NO: 993 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWCRELKSNYFDYWGQGTLVTVSSASTKGPSVFPLAPSSKS

SEQ ID NO: 994 - protein, 108 aa, Artificial Sequence; identical to SEQ ID NO: 260
  Synthetic polypeptide

SEQ ID NO: 995 - protein, 143 aa, Artificial Sequence; identical to SEQ ID NO: 285
  Synthetic polypeptide

SEQ ID NO: 996 - protein, 108 aa, Artificial Sequence; identical to SEQ ID NO: 260
  Synthetic polypeptide

SEQ ID NO: 997 - protein, 143 aa, Artificial Sequence; identical to SEQ ID NO: 293
  Synthetic polypeptide

SEQ ID NO: 998 - protein, 108 aa, Artificial Sequence; identical to SEQ ID NO: 260
  Synthetic polypeptide

SEQ ID NO: 999 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFAELKSNYFDYWGQGTLVTVSSASTKGPSVFPLAPSSKS

SEQ ID NO: 1000 - protein, 108 aa, Artificial Sequence; identical to SEQ ID NO: 260
  Synthetic polypeptide

SEQ ID NO: 1001 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFCELKSNYFDYWGQGTLVTVSSASTKGPSVFPLAPSSKS

SEQ ID NO: 1002 - protein, 108 aa, Artificial Sequence; identical to SEQ ID NO: 260
  Synthetic polypeptide

SEQ ID NO: 1003 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFEELKSNYFDYWGQGTLVTVSSASTKGPSVFPLAPSSKS

SEQ ID NO: 1004 - protein, 108 aa, Artificial Sequence; identical to SEQ ID NO: 260
  Synthetic polypeptide

SEQ ID NO: 1005 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFFELKSNYFDYWGQGTLVTVSSASTKGPSVFPLAPSSKS

SEQ ID NO: 1006 - protein, 108 aa, Artificial Sequence; identical to SEQ ID NO: 260
  Synthetic polypeptide

SEQ ID NO: 1007 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMHSLRAEDTAVYYCARGGLLLWFGELKSNYFDYWGQGTLVTVSSASTKGPSVFPLAPSSKS

SEQ ID NO: 1008 - protein, 108 aa, Artificial Sequence; identical to SEQ ID NO: 260
  Synthetic polypeptide

SEQ ID NO: 1009 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFHELKSNYFDYWGQGTLVTVSSASTKGPSVFPLAPSSKS

SEQ ID NO: 1010 - protein, 108 aa, Artificial Sequence; identical to SEQ ID NO: 260
  Synthetic polypeptide

SEQ ID NO: 1011 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFKELKSNYFDYWGQGTLVTVSSASTKGPSVFPLAPSSKS

SEQ ID NO: 1012 - protein, 108 aa, Artificial Sequence; identical to SEQ ID NO: 260
  Synthetic polypeptide

SEQ ID NO: 1013 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFLELKSNYFDYWGQGTLVTVSSASTKGPSVFPLAPSSKS

SEQ ID NO: 1014 - protein, 108 aa, Artificial Sequence; identical to SEQ ID NO: 260
  Synthetic polypeptide

SEQ ID NO: 1015 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFMELKSNYFDYWGQGTLVTVSSASTKGPSVFPLAPSSKS

SEQ ID NO: 1016 - protein, 108 aa, Artificial Sequence; identical to SEQ ID NO: 260
  Synthetic polypeptide

SEQ ID NO: 1017 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFPELKSNYFDYWGQGTLVTVSSASTKGPSVFPLAPSSKS

SEQ ID NO: 1018 - protein, 108 aa, Artificial Sequence; identical to SEQ ID NO: 260
  Synthetic polypeptide

SEQ ID NO: 1019 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFQELKSNYFDYWGQGTLVTVSSASTKGPSVFPLAPSSKS

SEQ ID NO: 1020 - protein, 108 aa, Artificial Sequence; identical to SEQ ID NO: 260
  Synthetic polypeptide

SEQ ID NO: 1021 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRALKSNYFDYWGQGTLVTVSSASTKGPSVFPLAPSSKS

SEQ ID NO: 1022 - protein, 108 aa, Artificial Sequence; identical to SEQ ID NO: 260
  Synthetic polypeptide

SEQ ID NO: 1023 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRCLKSNYFDYWGQGTLVTVSSASTKGPSVFPLAPSSKS

SEQ ID NO: 1024 - protein, 108 aa, Artificial Sequence; identical to SEQ ID NO: 260
  Synthetic polypeptide

SEQ ID NO: 1025 - protein, 143 aa, Artificial Sequence; identical to SEQ ID NO: 261
  Synthetic polypeptide

SEQ ID NO: 1026 - protein, 108 aa, Artificial Sequence; identical to SEQ ID NO: 260
  Synthetic polypeptide

SEQ ID NO: 1027 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRGLKSNYFDYWGQGTLVTVSSASTKGPSVFPLAPSSKS

SEQ ID NO: 1028 - protein, 108 aa, Artificial Sequence; identical to SEQ ID NO: 260
  Synthetic polypeptide

SEQ ID NO: 1029 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRHLKSNYFDYWGQGTLVTVSSASTKGPSVFPLAPSSKS

SEQ ID NO: 1030 - protein, 108 aa, Artificial Sequence; identical to SEQ ID NO: 260
  Synthetic polypeptide

SEQ ID NO: 1031 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRKLKSNYFDYWGQGTLVTVSSASTKGPSVFPLAPSSKS

SEQ ID NO: 1032 - protein, 108 aa, Artificial Sequence; identical to SEQ ID NO: 260
  Synthetic polypeptide

SEQ ID NO: 1033 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRLLKSNYFDYWGQGTLVTVSSASTKGPSVFPLAPSSKS

SEQ ID NO: 1034 - protein, 108 aa, Artificial Sequence; identical to SEQ ID NO: 260
  Synthetic polypeptide

SEQ ID NO: 1035 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRNLKSNYFDYWGQGTLVTVSSASTKGPSVFPLAPSSKS

SEQ ID NO: 1036 - protein, 108 aa, Artificial Sequence; identical to SEQ ID NO: 260
  Synthetic polypeptide

SEQ ID NO: 1037 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRPLKSNYFDYWGQGTLVTVSSASTKGPSVFPLAPSSKS

SEQ ID NO: 1038 - protein, 108 aa, Artificial Sequence; identical to SEQ ID NO: 260
  Synthetic polypeptide

SEQ ID NO: 1039 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRQLKSNYFDYWGQGTLVTVSSASTKGPSVFPLAPSSKS

SEQ ID NO: 1040 - protein, 108 aa, Artificial Sequence; identical to SEQ ID NO: 260
  Synthetic polypeptide

SEQ ID NO: 1041 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRRLKSNYFDYWGQGTLVTVSSASTKGPSVFPLAPSSKS

SEQ ID NO: 1042 - protein, 108 aa, Artificial Sequence; identical to SEQ ID NO: 260
  Synthetic polypeptide

SEQ ID NO: 1043 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRSLKSNYFDYWGQGTLVTVSSASTKGPSVFPLAPSSKS

SEQ ID NO: 1044 - protein, 108 aa, Artificial Sequence; identical to SEQ ID NO: 260
  Synthetic polypeptide

SEQ ID NO: 1045 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRTLKSNYFDYWGQGTLVTVSSASTKGPSVFPLAPSSKS

SEQ ID NO: 1046 - protein, 108 aa, Artificial Sequence; identical to SEQ ID NO: 260
  Synthetic polypeptide

SEQ ID NO: 1047 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRVLKSNYFDYWGQGTLVTVSSASTKGPSVFPLAPSSKS

SEQ ID NO: 1048 - protein, 108 aa, Artificial Sequence; identical to SEQ ID NO: 260
  Synthetic polypeptide

SEQ ID NO: 1049 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRWLKSNYFDYWGQGTLVTVSSASTKGPSVFPLAPSSKS

SEQ ID NO: 1050 - protein, 108 aa, Artificial Sequence; identical to SEQ ID NO: 260
  Synthetic polypeptide

SEQ ID NO: 1051 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRYLKSNYFDYWGQGTLVTVSSASTKGPSVFPLAPSSKS

SEQ ID NO: 1052 - protein, 108 aa, Artificial Sequence; identical to SEQ ID NO: 260
  Synthetic polypeptide

SEQ ID NO: 1053 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFSELKSNYFDYWGQGTLVTVSSASTKGPSVFPLAPSSKS

SEQ ID NO: 1054 - protein, 108 aa, Artificial Sequence; identical to SEQ ID NO: 260
  Synthetic polypeptide

SEQ ID NO: 1055 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFTELKSNYFDYWGQGTLVTVSSASTKGPSVFPLAPSSKS

SEQ ID NO: 1056 - protein, 108 aa, Artificial Sequence; identical to SEQ ID NO: 260
  Synthetic polypeptide

SEQ ID NO: 1057 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFVELKSNYFDYWGQGTLVTVSSASTKGPSVFPLAPSSKS

SEQ ID NO: 1058 - protein, 108 aa, Artificial Sequence; identical to SEQ ID NO: 260
  Synthetic polypeptide

SEQ ID NO: 1059 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFWELKSNYFDYWGQGTLVTVSSASTKGPSVFPLAPSSKS

SEQ ID NO: 1060 - protein, 108 aa, Artificial Sequence; identical to SEQ ID NO: 260
  Synthetic polypeptide

SEQ ID NO: 1061 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFYELKSNYFDYWGQGTLVTVSSASTKGPSVFPLAPSSKS

SEQ ID NO: 1062 - protein, 108 aa, Artificial Sequence; identical to SEQ ID NO: 260
  Synthetic polypeptide

SEQ ID NO: 1063 - protein, 143 aa, Artificial Sequence; identical to SEQ ID NO: 281
  Synthetic polypeptide

SEQ ID NO: 1064 - protein, 108 aa, Artificial Sequence; identical to SEQ ID NO: 260
  Synthetic polypeptide

SEQ ID NO: 1065 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWKRELKSNYFDYWGQGTLVTVSSASTKGPSVFPLAPSSKS

SEQ ID NO: 1066 - protein, 108 aa, Artificial Sequence; identical to SEQ ID NO: 260
  Synthetic polypeptide

SEQ ID NO: 1067 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWLRELKSNYFDYWGQGTLVTVSSASTKGPSVFPLAPSSKS

SEQ ID NO: 1068 - protein, 108 aa, Artificial Sequence; identical to SEQ ID NO: 260
  Synthetic polypeptide

SEQ ID NO: 1069 - protein, 143 aa, Artificial Sequence; identical to SEQ ID NO: 279
  Synthetic polypeptide

SEQ ID NO: 1070 - protein, 108 aa, Artificial Sequence; identical to SEQ ID NO: 260
  Synthetic polypeptide

SEQ ID NO: 1071 - protein, 143 aa, Artificial Sequence; identical to SEQ ID NO: 283
  Synthetic polypeptide

SEQ ID NO: 1072 - protein, 108 aa, Artificial Sequence; identical to SEQ ID NO: 260
  Synthetic polypeptide

SEQ ID NO: 1073 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWPRELKSNYFDYWGQGTLVTVSSASTKGPSVFPLAPSSKS

SEQ ID NO: 1074 - protein, 108 aa, Artificial Sequence; identical to SEQ ID NO: 260
  Synthetic polypeptide

SEQ ID NO: 1075 - protein, 143 aa, Artificial Sequence; identical to SEQ ID NO: 287
  Synthetic polypeptide

SEQ ID NO: 1076 - protein, 108 aa, Artificial Sequence; identical to SEQ ID NO: 260
  Synthetic polypeptide

SEQ ID NO: 1077 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWRRELKSNYFDYWGQGTLVTVSSASTKGPSVFPLAPSSKS

SEQ ID NO: 1078 - protein, 108 aa, Artificial Sequence; identical to SEQ ID NO: 260
  Synthetic polypeptide

SEQ ID NO: 1079 - protein, 143 aa, Artificial Sequence; identical to SEQ ID NO: 277
  Synthetic polypeptide

SEQ ID NO: 1080 - protein, 108 aa, Artificial Sequence; identical to SEQ ID NO: 260
  Synthetic polypeptide

SEQ ID NO: 1081 - protein, 143 aa, Artificial Sequence; identical to SEQ ID NO: 289
  Synthetic polypeptide

SEQ ID NO: 1082 - protein, 108 aa, Artificial Sequence; identical to SEQ ID NO: 260
  Synthetic polypeptide

SEQ ID NO: 1083 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWWRELKSNYFDYWGQGTLVTVSSASTKGPSVFPLAPSSKS

SEQ ID NO: 1084 - protein, 108 aa, Artificial Sequence; identical to SEQ ID NO: 260
  Synthetic polypeptide

SEQ ID NO: 1085 - protein, 143 aa, Artificial Sequence
  Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWYRELKSNYFDYWGQGTLVTVSSASTKGPSVFPLAPSSKS

SEQ ID NO: 1086 - protein, 11 aa, Artificial Sequence
  Synthetic polypeptide
RASQPIDNYLN

SEQ ID NO: 1087 - protein, 7 aa, Artificial Sequence
  Synthetic polypeptide
AASRLQS

SEQ ID NO: 1088 - protein, 9 aa, Artificial Sequence
  Synthetic polypeptide
QQSYTVPYT

SEQ ID NO: 1089 - protein, 5 aa, Artificial Sequence
  Synthetic polypeptide
AYSMI

SEQ ID NO: 1090 - protein, 17 aa, Artificial Sequence
  Synthetic polypeptide
YIRPSGGRTTYADSVKG

SEQ ID NO: 1091 - protein, 17 aa, Artificial Sequence
  Synthetic polypeptide
GGLLLWNRELKSNYFDY

SEQ ID NO: 1092 - protein, 17 aa, Artificial Sequence
  Synthetic polypeptide
GGLLLWARELKSNYFDY

SEQ ID NO: 1093 - protein, 11 aa, Artificial Sequence
  Synthetic polypeptide
RAGRSISTYVN

SEQ ID NO: 1094 - protein, 12 aa, Artificial Sequence
  Synthetic polypeptide
RASQIVSSRYLA

SEQ ID NO: 1095 - protein, 11 aa, Artificial Sequence
  Synthetic polypeptide
RASQSISNYLN

SEQ ID NO: 1096 - protein, 12 aa, Artificial Sequence
  Synthetic polypeptide
RASQIVSSNYLA

SEQ ID NO: 1097 - protein, 12 aa, Artificial Sequence
  Synthetic polypeptide
RTSQFVNSNYLA

SEQ ID NO: 1098 - protein, 12 aa, Artificial Sequence
  Synthetic polypeptide
RTSQFVNSNYLA

SEQ ID NO: 1099 - protein, 7 aa, Artificial Sequence
  Synthetic polypeptide
AASSLQS

SEQ ID NO: 1100 - protein, 7 aa, Artificial Sequence
  Synthetic polypeptide
GAASRAT

SEQ ID NO: 1101 - protein, 7 aa, Artificial Sequence
  Synthetic polypeptide
AASSLQS

SEQ ID NO: 1102 - protein, 7 aa, Artificial Sequence
  Synthetic polypeptide
GASNRAT

SEQ ID NO: 1103 - protein, 7 aa, Artificial Sequence
  Synthetic polypeptide
GASSRAT

SEQ ID NO: 1104 - protein, 7 aa, Artificial Sequence
  Synthetic polypeptide
GASSRAT

SEQ ID NO: 1105 - protein, 9 aa, Artificial Sequence
  Synthetic polypeptide
QQSQSTPYT

SEQ ID NO: 1106 - protein, 9 aa, Artificial Sequence
  Synthetic polypeptide
QQTYSSPFT

SEQ ID NO: 1107 - protein, 9 aa, Artificial Sequence
  Synthetic polypeptide
QQSYTSPYT

SEQ ID NO: 1108 - protein, 9 aa, Artificial Sequence
  Synthetic polypeptide
QQSFNIPYT

SEQ ID NO: 1109 - protein, 9 aa, Artificial Sequence
  Synthetic polypeptide
QQSSRTPWT

SEQ ID NO: 1110 - protein, 9 aa, Artificial Sequence
  Synthetic polypeptide
QQSSRTPWT

SEQ ID NO: 1111 - protein, 5 aa, Artificial Sequence
  Synthetic polypeptide
HYLMT

SEQ ID NO: 1112 - protein, 17 aa, Artificial Sequence
  Synthetic polypeptide
YISPSGGHTIYADSVKG

SEQ ID NO: 1113 - protein, 16 aa, Artificial Sequence
  Synthetic polypeptide
VARGIAARSRTSYFDY

SEQ ID NO: 1114 - protein, 108 aa, Artificial Sequence
  Synthetic polypeptide
QDIQMTQSPSSLSASVGDRVTVTCRAGRSISTYVNWYQQKPGKAPKLLIYAASSLQSGVPSRFSGSRSGTDFTLTISSLQPEDFATYYCQQSQSTPYTFGQGTKLEVK

SEQ ID NO: 1115 - protein, 142 aa, Artificial Sequence; identical to SEQ ID NO: 271
  Synthetic polypeptide

SEQ ID NO: 1116 - protein, 109 aa, Artificial Sequence
  Synthetic polypeptide
QDIQMTQSPGTLSLSPGERATLSCRASQIVSSRYLAWYQQRPGQAPRLLIYGAASRATGIPDRFSGSGSGTDFTLTISSLQAEDFATYYCQQTYSSPFTFGQGTKMEIK

SEQ ID NO: 1117 - protein, 142 aa, Artificial Sequence; identical to SEQ ID NO: 271
  Synthetic polypeptide

SEQ ID NO: 1118 - protein, 109 aa, Artificial Sequence
  Synthetic polypeptide
QDIQMTQSPGTLSLSPGERATLSCRTSQFVNSNYLAWYQQTPGQAPRLLIYGASSRATGIPDRFSGTGYGTDFTLTISRLEPEDYGTYYCQQSSRTPWTFGQGTRVEIK

SEQ ID NO: 1119 - protein, 142 aa, Artificial Sequence; identical to SEQ ID NO: 271
  Synthetic polypeptide

SEQ ID NO: 1120 - protein, 110 aa, Artificial Sequence
  Synthetic polypeptide
QDIQMTQSPDSLSASVGDRVTITCRASQSISNYLNWYQQKPGKAPKLLIYAASSLQSGVPSRFSGSGSGTDFTLTISGLQPEDFASYYCQQSYTSPYTFVQGTKLEIKRT

SEQ ID NO: 1121 - protein, 142 aa, Artificial Sequence; identical to SEQ ID NO: 271
  Synthetic polypeptide

SEQ ID NO: 1122 - protein, 109 aa, Artificial Sequence
  Synthetic polypeptide
QDIQMTQSPATLSLSPGERATLSCRASQIVSSNYLAWYQQKPGQAPRLLIYGASNRATGIPDRFSGSGSGTEFTLTISSLQSEDFAIYYCQQSFNIPYTFGQGTRVDIK

SEQ ID NO: 1123 - protein, 142 aa, Artificial Sequence; identical to SEQ ID NO: 271
  Synthetic polypeptide

SEQ ID NO: 1124 - protein, 11 aa, Artificial Sequence
  Synthetic polypeptide
RASQSISSWLA

SEQ ID NO: 1125 - protein, 7 aa, Artificial Sequence
  Synthetic polypeptide
KASTLES

SEQ ID NO: 1126 - protein, 8 aa, Artificial Sequence
  Synthetic polypeptide
QQYNTYWT

SEQ ID NO: 1127 - protein, 5 aa, Artificial Sequence
  Synthetic polypeptide
HYIMM

SEQ ID NO: 1128 - protein, 5 aa, Artificial Sequence
  Synthetic polypeptide
IYSMH

SEQ ID NO: 1129 - protein, 5 aa, Artificial Sequence
  Synthetic polypeptide
VYNMH

SEQ ID NO: 1130 - protein, 5 aa, Artificial Sequence
  Synthetic polypeptide
HYIMM

SEQ ID NO: 1131 - protein, 5 aa, Artificial Sequence
  Synthetic polypeptide
HYIMM

SEQ ID NO: 1132 - protein, 5 aa, Artificial Sequence
  Synthetic polypeptide
IYSMH

SEQ ID NO: 1133 - protein, 5 aa, Artificial Sequence
  Synthetic polypeptide
HYIMM

SEQ ID NO: 1134 - protein, 5 aa, Artificial Sequence
  Synthetic polypeptide
HYIMM

SEQ ID NO: 1135 - protein, 5 aa, Artificial Sequence
  Synthetic polypeptide
HYIMM

SEQ ID NO: 1136 - protein, 5 aa, Artificial Sequence
  Synthetic polypeptide
IYDMI

SEQ ID NO: 1137 - protein, 5 aa, Artificial Sequence
  Synthetic polypeptide
HYIMM

SEQ ID NO: 1138 - protein, 5 aa, Artificial Sequence
  Synthetic polypeptide
VYNMH

SEQ ID NO: 1139 - protein, 5 aa, Artificial Sequence
  Synthetic polypeptide
IYDMT

SEQ ID NO: 1140 - protein, 5 aa, Artificial Sequence
  Synthetic polypeptide
HYIMM

SEQ ID NO: 1141 - protein, 5 aa, Artificial Sequence
  Synthetic polypeptide
SYNMH

SEQ ID NO: 1142 - protein, 5 aa, Artificial Sequence
  Synthetic polypeptide
RYSMR

SEQ ID NO: 1143 - protein, 5 aa, Artificial Sequence
  Synthetic polypeptide
IYSMQ

SEQ ID NO: 1144 - protein, 5 aa, Artificial Sequence
  Synthetic polypeptide
VYSMT

SEQ ID NO: 1145 - protein, 5 aa, Artificial Sequence
  Synthetic polypeptide
IYDMN

SEQ ID NO: 1146 - protein, 5 aa, Artificial Sequence
  Synthetic polypeptide
HYIMM

SEQ ID NO: 1147 - protein, 6 aa, Artificial Sequence
  Synthetic polypeptide
HYMGMN

SEQ ID NO: 1148 - protein, 5 aa, Artificial Sequence
  Synthetic polypeptide
TYTMR

SEQ ID NO: 1149 - protein, 5 aa, Artificial Sequence
  Synthetic polypeptide
IYDMW

SEQ ID NO: 1150 - protein, 5 aa, Artificial Sequence
  Synthetic polypeptide
IYNMI

SEQ ID NO: 1151 - protein, 5 aa, Artificial Sequence
  Synthetic polypeptide
IYHMY

SEQ ID NO: 1152 - protein, 5 aa, Artificial Sequence
  Synthetic polypeptide
TYSMY

SEQ ID NO: 1153 - protein, 5 aa, Artificial Sequence
  Synthetic polypeptide
HYIMM

SEQ ID NO: 1154 - protein, 5 aa, Artificial Sequence
  Synthetic polypeptide
IYDMY

SEQ ID NO: 1155 - protein, 5 aa, Artificial Sequence
  Synthetic polypeptide
VYSMW

SEQ ID NO: 1156 - protein, 5 aa, Artificial Sequence
  Synthetic polypeptide
HYIMM

SEQ ID NO: 1157 - protein, 5 aa, Artificial Sequence
  Synthetic polypeptide
IYGMF

SEQ ID NO: 1158 - protein, 5 aa, Artificial Sequence
  Synthetic polypeptide
IYSMF

SEQ ID NO: 1159 - protein, 5 aa, Artificial Sequence
  Synthetic polypeptide
IYSMY

SEQ ID NO: 1160 - protein, 5 aa, Artificial Sequence
  Synthetic polypeptide
RYSMI

SEQ ID NO: 1161 - protein, 5 aa, Artificial Sequence
  Synthetic polypeptide
HYIMM

SEQ ID NO: 1162 - protein, 5 aa, Artificial Sequence
  Synthetic polypeptide
HYIMM

SEQ ID NO: 1163 - protein, 5 aa, Artificial Sequence
  Synthetic polypeptide
KYWMY

SEQ ID NO: 1164 - protein, 5 aa, Artificial Sequence
  Synthetic polypeptide
RYQMH

SEQ ID NO: 1165 - protein, 5 aa, Artificial Sequence
  Synthetic polypeptide
PYNMY

SEQ ID NO: 1166 - protein, 5 aa, Artificial Sequence
  Synthetic polypeptide
HYIMM

SEQ ID NO: 1167 - protein, 5 aa, Artificial Sequence
  Synthetic polypeptide
HYIMM

SEQ ID NO: 1168 - protein, 5 aa, Artificial Sequence
  Synthetic polypeptide
HYIMM

SEQ ID NO: 1169 - protein, 5 aa, Artificial Sequence
  Synthetic polypeptide
MYQMF

SEQ ID NO: 1170 - protein, 5 aa, Artificial Sequence
  Synthetic polypeptide
HYIMM

SEQ ID NO: 1171 - protein, 5 aa, Artificial Sequence
  Synthetic polypeptide
RYKMY

SEQ ID NO: 1172 - protein, 5 aa, Artificial Sequence
  Synthetic polypeptide
RYVMW

SEQ ID NO: 1173 - protein, 5 aa, Artificial Sequence
  Synthetic polypeptide
HYIMM

SEQ ID NO: 1174 - protein, 5 aa, Artificial Sequence
  Synthetic polypeptide
HYIMM

SEQ ID NO: 1175 - protein, 5 aa, Artificial Sequence
  Synthetic polypeptide
HYIMM

SEQ ID NO: 1176 - protein, 5 aa, Artificial Sequence
  Synthetic polypeptide
KYSMA

SEQ ID NO: 1177 - protein, 5 aa, Artificial Sequence
  Synthetic polypeptide
IYFMS

SEQ ID NO: 1178 - protein, 5 aa, Artificial Sequence
  Synthetic polypeptide
QYFMH

SEQ ID NO: 1179 - protein, 5 aa, Artificial Sequence
  Synthetic polypeptide
IYTMY

SEQ ID NO: 1180 - protein, 5 aa, Artificial Sequence
  Synthetic polypeptide
PYLMW

SEQ ID NO: 1181 - protein, 5 aa, Artificial Sequence
  Synthetic polypeptide
IYTMM

SEQ ID NO: 1182 - protein, 5 aa, Artificial Sequence
  Synthetic polypeptide
HYIMM

SEQ ID NO: 1183 - protein, 5 aa, Artificial Sequence
  Synthetic polypeptide
HYIMM

SEQ ID NO: 1184 - protein, 5 aa, Artificial Sequence
  Synthetic polypeptide
RYSMS

SEQ ID NO: 1185 - protein, 5 aa, Artificial Sequence
  Synthetic polypeptide
WYMMQ

SEQ ID NO: 1186 - protein, 5 aa, Artificial Sequence
  Synthetic polypeptide
QYMMM

SEQ ID NO: 1187 - protein, 5 aa, Artificial Sequence
  Synthetic polypeptide
VYAMR

SEQ ID NO: 1188 - protein, 5 aa, Artificial Sequence
  Synthetic polypeptide
PYNMM

SEQ ID NO: 1189 - protein, 5 aa, Artificial Sequence
  Synthetic polypeptide
VYSMH

SEQ ID NO: 1190 - protein, 5 aa, Artificial Sequence
  Synthetic polypeptide
HYIMM

SEQ ID NO: 1191 - protein, 5 aa, Artificial Sequence
  Synthetic polypeptide
HYIMM

SEQ ID NO: 1192 - protein, 5 aa, Artificial Sequence
  Synthetic polypeptide
LYVMY

SEQ ID NO: 1193 - protein, 5 aa, Artificial Sequence
  Synthetic polypeptide
PYDML

SEQ ID NO: 1194 - protein, 5 aa, Artificial Sequence
  Synthetic polypeptide
QYTMV

SEQ ID NO: 1195 - protein, 5 aa, Artificial Sequence
  Synthetic polypeptide
HYIMM

SEQ ID NO: 1196 - protein, 5 aa, Artificial Sequence
  Synthetic polypeptide
HYIMM

SEQ ID NO: 1197 - protein, 5 aa, Artificial Sequence
  Synthetic polypeptide
PYMMM

SEQ ID NO: 1198 - protein, 5 aa, Artificial Sequence
  Synthetic polypeptide
HYIMM

SEQ ID NO: 1199 - protein, 5 aa, Artificial Sequence
  Synthetic polypeptide
NYSMD

SEQ ID NO: 1200 - protein, 5 aa, Artificial Sequence
  Synthetic polypeptide
HYVMM

SEQ ID NO: 1201 - protein, 5 aa, Artificial Sequence
  Synthetic polypeptide
HYIMM

SEQ ID NO: 1202 - protein, 5 aa, Artificial Sequence
  Synthetic polypeptide
IYLMI

SEQ ID NO: 1203 - protein, 5 aa, Artificial Sequence
  Synthetic polypeptide
YYIMF

SEQ ID NO: 1204 - protein, 5 aa, Artificial Sequence
  Synthetic polypeptide
HYIMM

SEQ ID NO: 1205 - protein, 5 aa, Artificial Sequence
  Synthetic polypeptide
HYIMM

SEQ ID NO: 1206 - protein, 5 aa, Artificial Sequence
  Synthetic polypeptide
TYAMV

SEQ ID NO: 1207 - protein, 5 aa, Artificial Sequence
  Synthetic polypeptide
HYIMM

SEQ ID NO: 1208 - protein, 5 aa, Artificial Sequence
  Synthetic polypeptide
PYTMI

SEQ ID NO: 1209 - protein, 17 aa, Artificial Sequence
  Synthetic polypeptide
GIYSSGGITVYADSVKG

SEQ ID NO: 1210 - protein, 17 aa, Artificial Sequence
  Synthetic polypeptide
SIYPSRGMTWYADSVKG

SEQ ID NO: 1211 - protein, 17 aa, Artificial Sequence
  Synthetic polypeptide
SIYPSGGMTYYADSVKG

SEQ ID NO: 1212 - protein, 17 aa, Artificial Sequence
  Synthetic polypeptide
GIYSSGGITVYADSVKG

SEQ ID NO: 1213 - protein, 17 aa, Artificial Sequence
  Synthetic polypeptide
GIYSSGGITVYADSVKG

SEQ ID NO: 1214 - protein, 17 aa, Artificial Sequence
  Synthetic polypeptide
SIYSSGGPTKYADSVKG

SEQ ID NO: 1215 - protein, 17 aa, Artificial Sequence
  Synthetic polypeptide
GIYSSGGITVYADSVKG

SEQ ID NO: 1216 - protein, 17 aa, Artificial Sequence
  Synthetic polypeptide
GIYSSGGITVYADSVKG

SEQ ID NO: 1217 - protein, 17 aa, Artificial Sequence
  Synthetic polypeptide
GIYSSGGITVYADSVKG

SEQ ID NO: 1218 - protein, 17 aa, Artificial Sequence
  Synthetic polypeptide
SIYPSGGNTSYADSVKG

SEQ ID NO: 1219 - protein, 17 aa, Artificial Sequence
  Synthetic polypeptide
GIYSSGGITVYADSVKG

SEQ ID NO: 1220 - protein, 17 aa, Artificial Sequence
  Synthetic polypeptide
SIYPSGGMTTYADSVKG

SEQ ID NO: 1221 - protein, 17 aa, Artificial Sequence
  Synthetic polypeptide
SIYPSGGQTIYADSVKG

SEQ ID NO: 1222 - protein, 17 aa, Artificial Sequence
  Synthetic polypeptide
GIYSSGGITVYADSVKG

SEQ ID NO: 1223 - protein, 17 aa, Artificial Sequence
  Synthetic polypeptide
SIVPSGGKTNYADSVKG

SEQ ID NO: 1224 - protein, 17 aa, Artificial Sequence
  Synthetic polypeptide
VIYPSGGQTYYADSVKG

SEQ ID NO: 1225 - protein, 17 aa, Artificial Sequence
  Synthetic polypeptide
SIGSSGGKTLYADSVKG

SEQ ID NO: 1226 - protein, 17 aa, Artificial Sequence
  Synthetic polypeptide
SIGSSGGSTTYADSVKG

SEQ ID NO: 1227 - protein, 17 aa, Artificial Sequence
  Synthetic polypeptide
SIYPSGGRTRYADSVKG

SEQ ID NO: 1228 - protein, 17 aa, Artificial Sequence
  Synthetic polypeptide
GIYSSGGITVYADSVKG

SEQ ID NO: 1229 - protein, 17 aa, Artificial Sequence
  Synthetic polypeptide
SIVPSGGWTQYADSVKG

SEQ ID NO: 1230 - protein, 17 aa, Artificial Sequence
  Synthetic polypeptide
SIYPSGGKTQYADSVKG

SEQ ID NO: 1231 - protein, 17 aa, Artificial Sequence
  Synthetic polypeptide
SIRPSGGITKYADSVKG

SEQ ID NO: 1232 - protein, 17 aa, Artificial Sequence
  Synthetic polypeptide
SIYPSGGWTTYADSVKG

SEQ ID NO: 1233 - protein, 17 aa, Artificial Sequence
  Synthetic polypeptide
SIGPSGGPTGYADSVKG

SEQ ID NO: 1234 - protein, 17 aa, Artificial Sequence
  Synthetic polypeptide
SIYPSGGLTWYADSVKG

SEQ ID NO: 1235 - protein, 17 aa, Artificial Sequence
  Synthetic polypeptide
GIYSSGGITVYADSVKG

SEQ ID NO: 1236 - protein, 17 aa, Artificial Sequence
  Synthetic polypeptide
SIGPSGGPTAYADSVKG

SEQ ID NO: 1237 - protein, 17 aa, Artificial Sequence
  Synthetic polypeptide
SISSSGGMTEYADSVKG

SEQ ID NO: 1238 - protein, 17 aa, Artificial Sequence
  Synthetic polypeptide
GIYSSGGITVYADSVKG

SEQ ID NO: 1239 - protein, 17 aa, Artificial Sequence
  Synthetic polypeptide
GIGPSGGPTKYADSVKG

SEQ ID NO: 1240 - protein, 17 aa, Artificial Sequence
  Synthetic polypeptide
SIGPSGGVTHYADSVKG

SEQ ID NO: 1241 - protein, 17 aa, Artificial Sequence
  Synthetic polypeptide
YIRPSGGNTKYADSVKG

SEQ ID NO: 1242 - protein, 17 aa, Artificial Sequence
  Synthetic polypeptide
SIWSSGGATEYADSVKG

SEQ ID NO: 1243 - protein, 17 aa, Artificial Sequence
  Synthetic polypeptide
GIYSSGGITVYADSVKG

SEQ ID NO: 1244 - protein, 17 aa, Artificial Sequence
  Synthetic polypeptide
GIYSSGGITVYADSVKG

SEQ ID NO: 1245 - protein, 17 aa, Artificial Sequence
  Synthetic polypeptide
YIRPSGGQTYYADSVKG

SEQ ID NO: 1246 - protein, 17 aa, Artificial Sequence
  Synthetic polypeptide
WISPSGGITGYADSVKG

SEQ ID NO: 1247 - protein, 16 aa, Artificial Sequence
  Synthetic polypeptide
WIVPGGVTKYADSVKG

SEQ ID NO: 1248 - protein, 17 aa, Artificial Sequence
  Synthetic polypeptide
GIYSSGGITVYADSVKG

SEQ ID NO: 1249 - protein, 17 aa, Artificial Sequence
  Synthetic polypeptide
GIYSSGGITVYADSVKG

SEQ ID NO: 1250 - protein, 17 aa, Artificial Sequence
  Synthetic polypeptide
GIYSSGGITVYADSVKG

SEQ ID NO: 1251 - protein, 16 aa, Artificial Sequence
  Synthetic polypeptide
SISPGGGTQYADSVKG

SEQ ID NO: 1252 - protein, 17 aa, Artificial Sequence
  Synthetic polypeptide
GIYSSGGITVYADSVKG

SEQ ID NO: 1253 - protein, 17 aa, Artificial Sequence
  Synthetic polypeptide
VIGPSGGATFYADSVKG

SEQ ID NO: 1254 - protein, 16 aa, Artificial Sequence
  Synthetic polypeptide
SISPSGDTHYADSVKG

SEQ ID NO: 1255 - protein, 17 aa, Artificial Sequence
  Synthetic polypeptide
GIYSSGGITVYADSVKG

SEQ ID NO: 1256 - protein, 17 aa, Artificial Sequence
  Synthetic polypeptide
GIYSSGGITVYADSVKG

SEQ ID NO: 1257 - protein, 17 aa, Artificial Sequence
  Synthetic polypeptide
GIYSSGGITVYADSVKG

SEQ ID NO: 1258 - protein, 17 aa, Artificial Sequence
  Synthetic polypeptide
GIYPSGGRTLYADSVKG

SEQ ID NO: 1259 - protein, 17 aa, Artificial Sequence
  Synthetic polypeptide
SIRSSGGPTWYADSVKG

SEQ ID NO: 1260 - protein, 17 aa, Artificial Sequence
  Synthetic polypeptide
YIYPSGGMTEYADSVKG

SEQ ID NO: 1261 - protein, 17 aa, Artificial Sequence
  Synthetic polypeptide
SISPSGGWTYYADSVKG

SEQ ID NO: 1262 - protein, 17 aa, Artificial Sequence
  Synthetic polypeptide
YIGPSGGPTHYADSVKG

SEQ ID NO: 1263 - protein, 17 aa, Artificial Sequence
  Synthetic polypeptide
SIWSSGGQTKYADSVKG

SEQ ID NO: 1264 - protein, 17 aa, Artificial Sequence
  Synthetic polypeptide
GIYSSGGITVYADSVKG

SEQ ID NO: 1265 - protein, 17 aa, Artificial Sequence
  Synthetic polypeptide
GIYSSGGITVYADSVKG

SEQ ID NO: 1266 - protein, 17 aa, Artificial Sequence
  Synthetic polypeptide
GISPSGGETSYADSVKG

SEQ ID NO: 1267 - protein, 16 aa, Artificial Sequence
  Synthetic polypeptide
RISPSGGTTYADSVKG

SEQ ID NO: 1268 - protein, 17 aa, Artificial Sequence
  Synthetic polypeptide
GISSSGGHTDYADSVKG

SEQ ID NO: 1269 - protein, 17 aa, Artificial Sequence
  Synthetic polypeptide
SIYPSGGKTWYADSVKG

SEQ ID NO: 1270 - protein, 17 aa, Artificial Sequence
  Synthetic polypeptide
SIWPSGGTTDYADSVKG

SEQ ID NO: 1271 - protein, 17 aa, Artificial Sequence
  Synthetic polypeptide
VIGPSGGITLYADSVKG

SEQ ID NO: 1272 - protein, 17 aa, Artificial Sequence
  Synthetic polypeptide
GIYSSGGITVYADSVKG

SEQ ID NO: 1273 - protein, 17 aa, Artificial Sequence
  Synthetic polypeptide
GIYSSGGITVYADSVKG

SEQ ID NO: 1274 - protein, 17 aa, Artificial Sequence
  Synthetic polypeptide
YIVPSGGPTAYADSVKG

SEQ ID NO: 1275 - protein, 17 aa, Artificial Sequence
  Synthetic polypeptide
YIVSSGGLTKYADSVKG

SEQ ID NO: 1276 - protein, 15 aa, Artificial Sequence
  Synthetic polypeptide
WIYSSRANYADSVKG

SEQ ID NO: 1277 - protein, 17 aa, Artificial Sequence
  Synthetic polypeptide
GIYSSGGITVYADSVKG

SEQ ID NO: 1278 - protein, 17 aa, Artificial Sequence
  Synthetic polypeptide
GIYSSGGITVYADSVKG

SEQ ID NO: 1279 - protein, 17 aa, Artificial Sequence
  Synthetic polypeptide
GIYPSGGYTVYADSVKG

SEQ ID NO: 1280 - protein, 17 aa, Artificial Sequence
  Synthetic polypeptide
GIYSSGGITVYADSVKG

SEQ ID NO: 1281 - protein, 17 aa, Artificial Sequence
  Synthetic polypeptide
RIYSSGGGTIYADSVKG

SEQ ID NO: 1282 - protein, 17 aa, Artificial Sequence
  Synthetic polypeptide
YIVPSGGVTAYADSVKG

SEQ ID NO: 1283 - protein, 17 aa, Artificial Sequence
  Synthetic polypeptide
GIYSSGGITVYADSVKG

SEQ ID NO: 1284 - protein, 17 aa, Artificial Sequence
  Synthetic polypeptide
YIGPSGGPTEYADSVKG

SEQ ID NO: 1285 - protein, 17 aa, Artificial Sequence
  Synthetic polypeptide
YISPSGGYTHYADSVKG

SEQ ID NO: 1286 - protein, 17 aa, Artificial Sequence
  Synthetic polypeptide
GIYSSGGITVYADSVKG

SEQ ID NO: 1287 - protein, 17 aa, Artificial Sequence
  Synthetic polypeptide
GIYSSGGITVYADSVKG

SEQ ID NO: 1288 - protein, 17 aa, Artificial Sequence
  Synthetic polypeptide
SIYPSGGITTYADSVKG

SEQ ID NO: 1289 - protein, 17 aa, Artificial Sequence
  Synthetic polypeptide
GIYSSGGITVYADSVKG

SEQ ID NO: 1290 - protein, 17 aa, Artificial Sequence
  Synthetic polypeptide
SISSSGGMTPYADSVKG

SEQ ID NO: 1291 - protein, 13 aa, Artificial Sequence
  Synthetic polypeptide
QRTGVPRRDSFNI

SEQ ID NO: 1292 - protein, 13 aa, Artificial Sequence
  Synthetic polypeptide
RRTGIPRRDAFDI

SEQ ID NO: 1293 - protein, 13 aa, Artificial Sequence
  Synthetic polypeptide
RRTGIPRRDAFDI

SEQ ID NO: 1294 - protein, 13 aa, Artificial Sequence
  Synthetic polypeptide
RRIGVPRRDEFDI

SEQ ID NO: 1295 - protein, 13 aa, Artificial Sequence
  Synthetic polypeptide
RRTGVPRWDDFDI

SEQ ID NO: 1296 - protein, 13 aa, Artificial Sequence
  Synthetic polypeptide
RRTGIPRRDAFDI

SEQ ID NO: 1297 - protein, 13 aa, Artificial Sequence
  Synthetic polypeptide
RRIGVPRRDSFDM

SEQ ID NO: 1298 - protein, 13 aa, Artificial Sequence
  Synthetic polypeptide
RRTGVPRWDDFDI

SEQ ID NO: 1299 - protein, 13 aa, Artificial Sequence
  Synthetic polypeptide
RRTGVPRRDEFDI

SEQ ID NO: 1300 - protein, 13 aa, Artificial Sequence
  Synthetic polypeptide
RRTGIPRRDAFDI

SEQ ID NO: 1301 - protein, 13 aa, Artificial Sequence
  Synthetic polypeptide
RRIGVPRRDSFDI

SEQ ID NO: 1302 - protein, 13 aa, Artificial Sequence
  Synthetic polypeptide
RRTGIPRRDAFDI

SEQ ID NO: 1303 - protein, 13 aa, Artificial Sequence
  Synthetic polypeptide
RRTGIPRRDAFDI

SEQ ID NO: 1304 - protein, 13 aa, Artificial Sequence
  Synthetic polypeptide
RRTGVPRRDSFDI

SEQ ID NO: 1305 - protein, 13 aa, Artificial Sequence
  Synthetic polypeptide
RRTGIPRRDAFDI

SEQ ID NO: 1306 - protein, 13 aa, Artificial Sequence
  Synthetic polypeptide
RRTGIPRRDAFDI

SEQ ID NO: 1307 - protein, 13 aa, Artificial Sequence
  Synthetic polypeptide
RRTGIPRRDAFDI

SEQ ID NO: 1308 - protein, 13 aa, Artificial Sequence
  Synthetic polypeptide
RRTGIPRRDAFDI

SEQ ID NO: 1309 - protein, 13 aa, Artificial Sequence
  Synthetic polypeptide
RRTGIPRRDAFDI

SEQ ID NO: 1310 - protein, 13 aa, Artificial Sequence
  Synthetic polypeptide
RRTGVPRRDDFDI

SEQ ID NO: 1311 - protein, 13 aa, Artificial Sequence
  Synthetic polypeptide
RRTGIPRRDAFDI

SEQ ID NO: 1312 - protein, 13 aa, Artificial Sequence
  Synthetic polypeptide
RRTGIPRRDAFDI

SEQ ID NO: 1313 - protein, 13 aa, Artificial Sequence
  Synthetic polypeptide
RRTGIPRRDAFDI

SEQ ID NO: 1314 - protein, 13 aa, Artificial Sequence
  Synthetic polypeptide
RRTGIPRRDAFDI

SEQ ID NO: 1315 - protein, 13 aa, Artificial Sequence
  Synthetic polypeptide
RRTGIPRRDAFDI

SEQ ID NO: 1316 - protein, 13 aa, Artificial Sequence
  Synthetic polypeptide
RRTGIPRRDAFDI

SEQ ID NO: 1317 - protein, 13 aa, Artificial Sequence
  Synthetic polypeptide
RRIGVPRRDDFDI

SEQ ID NO: 1318 - protein, 13 aa, Artificial Sequence
  Synthetic polypeptide
RRTGIPRRDAFDI

SEQ ID NO: 1319 - protein, 13 aa, Artificial Sequence
  Synthetic polypeptide
RRTGIPRRDAFDI

SEQ ID NO: 1320 - protein, 13 aa, Artificial Sequence
  Synthetic polypeptide
RRRGVPRRDDFDI

SEQ ID NO: 1321 - protein, 13 aa, Artificial Sequence
  Synthetic polypeptide
RRTGIPRRDAFDI

SEQ ID NO: 1322 - protein, 13 aa, Artificial Sequence
  Synthetic polypeptide
RRTGIPRRDAFDI

SEQ ID NO: 1323 - protein, 13 aa, Artificial Sequence
  Synthetic polypeptide
RRTGIPRRDAFDI

SEQ ID NO: 1324 - protein, 13 aa, Artificial Sequence
  Synthetic polypeptide
RRTGIPRRDAFDI

SEQ ID NO: 1325 - protein, 13 aa, Artificial Sequence
  Synthetic polypeptide
RRIGVPRRDAFDI

SEQ ID NO: 1326 - protein, 13 aa, Artificial Sequence
  Synthetic polypeptide
RRTGVPRRDSFEI

SEQ ID NO: 1327 - protein, 13 aa, Artificial Sequence
  Synthetic polypeptide
RRTGIPRRDAFDI

SEQ ID NO: 1328 - protein, 13 aa, Artificial Sequence
  Synthetic polypeptide
RRTGIPRRDAFDI

SEQ ID NO: 1329 - protein, 13 aa, Artificial Sequence
  Synthetic polypeptide
RRTGIPRRDAFDI

SEQ ID NO: 1330 - protein, 13 aa, Artificial Sequence
  Synthetic polypeptide
RRTGVPRRNAFDN

SEQ ID NO: 1331 - protein, 13 aa, Artificial Sequence
  Synthetic polypeptide
RRTGVPRRDAFDI

SEQ ID NO: 1332 - protein, 13 aa, Artificial Sequence
  Synthetic polypeptide
RRTGVPRWDAFDI

SEQ ID NO: 1333 - protein, 13 aa, Artificial Sequence
  Synthetic polypeptide
RRTGIPRRDAFDI

SEQ ID NO: 1334 - protein, 13 aa, Artificial Sequence
  Synthetic polypeptide
RRTGVPRRDVFDI

SEQ ID NO: 1335 - protein, 13 aa, Artificial Sequence
  Synthetic polypeptide
RRTGIPRRDAFDI

SEQ ID NO: 1336 - protein, 13 aa, Artificial Sequence
  Synthetic polypeptide
RRTGIPRRDAFDI

SEQ ID NO: 1337 - protein, 13 aa, Artificial Sequence
  Synthetic polypeptide
RRTGVPRRDAFDN

SEQ ID NO: 1338 - protein, 13 aa, Artificial Sequence
  Synthetic polypeptide
RRSGVPRRDDFDI

SEQ ID NO: 1339 - protein, 13 aa, Artificial Sequence
  Synthetic polypeptide
RRKGIPRRDDFDI

SEQ ID NO: 1340 - protein, 13 aa, Artificial Sequence
  Synthetic polypeptide
RRTGIPRRDAFDI

SEQ ID NO: 1341 - protein, 13 aa, Artificial Sequence
  Synthetic polypeptide
RRTGIPRRDAFDI

SEQ ID NO: 1342 - protein, 13 aa, Artificial Sequence
  Synthetic polypeptide
RRTGIPRRDAFDI

SEQ ID NO: 1343 - protein, 13 aa, Artificial Sequence
  Synthetic polypeptide
RRTGIPRRDAFDI

SEQ ID NO: 1344 - protein, 13 aa, Artificial Sequence
  Synthetic polypeptide
RRTGIPRRDAFDI

SEQ ID NO: 1345 - protein, 13 aa, Artificial Sequence
  Synthetic polypeptide
RRTGIPRRDAFDI

SEQ ID NO: 1346 - protein, 13 aa, Artificial Sequence
  Synthetic polypeptide
RRTGVPRRDALDN

SEQ ID NO: 1347 - protein, 13 aa, Artificial Sequence
  Synthetic polypeptide
RRPGVPRRDAFDI

SEQ ID NO: 1348 - protein, 13 aa, Artificial Sequence
  Synthetic polypeptide
RRTGIPRRDAFDI

SEQ ID NO: 1349 - protein, 13 aa, Artificial Sequence
  Synthetic polypeptide
RRTGIPRRDAFDI

SEQ ID NO: 1350 - protein, 13 aa, Artificial Sequence
  Synthetic polypeptide
RRTGIPRRDAFDI

SEQ ID NO: 1351 - protein, 13 aa, Artificial Sequence
  Synthetic polypeptide
RRTGIPRRDAFDI

SEQ ID NO: 1352 - protein, 13 aa, Artificial Sequence
  Synthetic polypeptide
RRTGIPRRDAFDI

SEQ ID NO: 1353 - protein, 13 aa, Artificial Sequence
  Synthetic polypeptide
RRTGIPRRDAFDI

SEQ ID NO: 1354 - protein, 13 aa, Artificial Sequence
  Synthetic polypeptide
RRRGIPRRDAFDI

SEQ ID NO: 1355 - protein, 13 aa, Artificial Sequence
  Synthetic polypeptide
RRMGIPRRNAFDI

SEQ ID NO: 1356 - protein, 13 aa, Artificial Sequence
  Synthetic polypeptide
RRTGIPRRDAFDI

SEQ ID NO: 1357 - protein, 13 aa, Artificial Sequence
  Synthetic polypeptide
RRTGIPRRDAFDI

SEQ ID NO: 1358 - protein, 13 aa, Artificial Sequence
  Synthetic polypeptide
RRTGIPRRDAFDI

SEQ ID NO: 1359 - protein, 13 aa, Artificial Sequence
  Synthetic polypeptide
RRTGIPRRDAFDN

SEQ ID NO: 1360 - protein, 13 aa, Artificial Sequence
  Synthetic polypeptide
RRTGIPRWDAFDI

SEQ ID NO: 1361 - protein, 13 aa, Artificial Sequence
  Synthetic polypeptide
RRTGIPRRDAFDI

SEQ ID NO: 1362 - protein, 13 aa, Artificial Sequence
  Synthetic polypeptide
RRTGIPRRDAFEI

SEQ ID NO: 1363 - protein, 13 aa, Artificial Sequence
  Synthetic polypeptide
RRTGIPRRDAFDI

SEQ ID NO: 1364 - protein, 13 aa, Artificial Sequence
  Synthetic polypeptide
RRTGIPRRDAFDI

SEQ ID NO: 1365 - protein, 13 aa, Artificial Sequence
  Synthetic polypeptide
RRTGIPRRDAFDS

SEQ ID NO: 1366 - protein, 13 aa, Artificial Sequence
  Synthetic polypeptide
RRTGIPRRDAFDI

SEQ ID NO: 1367 - protein, 13 aa, Artificial Sequence
  Synthetic polypeptide
RRTGIPRRDAFDI

SEQ ID NO: 1368 - protein, 13 aa, Artificial Sequence
  Synthetic polypeptide
RRTGIPRRDVFDI

SEQ ID NO: 1369 - protein, 13 aa, Artificial Sequence
  Synthetic polypeptide
RRTGIPRRDSFDI

SEQ ID NO: 1370 - protein, 13 aa, Artificial Sequence
  Synthetic polypeptide
RRTGIPRRDAFDI

SEQ ID NO: 1371 - protein, 13 aa, Artificial Sequence
  Synthetic polypeptide
RRSGIPRRDAFDI

SEQ ID NO: 1372 - protein, 13 aa, Artificial Sequence
  Synthetic polypeptide
RRTGIPRRDAFDI

SEQ ID NO: 1373 - protein, 107 aa, Artificial Sequence; identical to SEQ ID NO: 274
  Synthetic polypeptide

SEQ ID NO: 1374 - protein, 139 aa, Artificial Sequence
  Synthetic polypeptide
EVQLLESGGGLVQPGGSLRLSCAASGFTFSQYMMMWVRQAPGKGLEWVSGISSSGGHTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1375 - protein, 107 aa, Artificial Sequence; identical to SEQ ID NO: 274
  Synthetic polypeptide

SEQ ID NO: 1376 - protein, 139 aa, Artificial Sequence
  Synthetic polypeptide
EVQLLESGGGLVQPGGSLRLSCAASGFTFSPYMMMWVRQAPGKGLEWVSGIYPSGGYTVYADSVKGRFTISRDNSKNTLYLQMNSLRAEDTAVYYCAYRRTGIPRRDAFDIWGQGTMVTVSSASTKGPSVFPLAPSSKS

SEQ ID NO: 1377 - protein, 107 aa, Artificial Sequence; identical to SEQ ID NO: 274
  Synthetic polypeptide

SEQ ID NO: 1378 - protein, 139 aa, Artificial Sequence
  Synthetic polypeptide
EVQLLESGGGLVQPGGSLRLSCAASGFTFSPYLMWWVRQAPGKGLEWVSYIGPSGGPTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1379 - protein, 107 aa, Artificial Sequence; identical to SEQ ID NO: 274
  Synthetic polypeptide

SEQ ID NO: 1380 - protein, 139 aa, Artificial Sequence
  Synthetic polypeptide
EVQLLESGGGLVQPGGSLRLSCAASGFTFSKYWMYWVRQAPGKGLEWVSYIRPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1381 - protein, 107 aa, Artificial Sequence; identical to SEQ ID NO: 274
  Synthetic polypeptide

SEQ ID NO: 1382 - protein, 138 aa, Artificial Sequence
  Synthetic polypeptide
EVQLLESGGGLVQPGGSLRLSCAASGFTFSMYQMFWVRQAPGKGLEWVSSISPGGGTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1383 - protein, 107 aa, Artificial Sequence; identical to SEQ ID NO: 274
  Synthetic polypeptide

SEQ ID NO: 1384 - protein, 139 aa, Artificial Sequence
  Synthetic polypeptide
EVQLLESGGGLVQPGGSLRLSCAASGFTFSIYGMFWVRQAPGKGLEWVSGIGPSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1385 - protein, 107 aa, Artificial Sequence; identical to SEQ ID NO: 274
  Synthetic polypeptide

SEQ ID NO: 1386 - protein, 139 aa, Artificial Sequence
  Synthetic polypeptide
EVQLLESGGGLVQPGGSLRLSCAASGFTFSYYIMFWVRQAPGKGLEWVSYISPSGGYTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1387 - protein, 107 aa, Artificial Sequence; identical to SEQ ID NO: 274
  Synthetic polypeptide

SEQ ID NO: 1388 - protein, 139 aa, Artificial Sequence
  Synthetic polypeptide
EVQLLESGGGLVQPGGSLRLSCAASGFTFSHYVMMWVRQAPGKGLEWVSYIVPSGGVTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1389 - protein, 107 aa, Artificial Sequence; identical to SEQ ID NO: 274
  Synthetic polypeptide

SEQ ID NO: 1390 - protein, 139 aa, Artificial Sequence
  Synthetic polypeptide
EVQLLESGGGLVQPGGSLRLSCAASGFTFSPYNMMWVRQAPGKGLEWVSSIWPSGGTTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1391 - protein, 107 aa, Artificial Sequence; identical to SEQ ID NO: 274
  Synthetic polypeptide

SEQ ID NO: 1392 - protein, 139 aa, Artificial Sequence
  Synthetic polypeptide
EVQLLESGGGLVQPGGSLRLSCAASGFTFSIYSMHWVRQAPGKGLEWVSSIYPSRGMTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1393 - protein, 107 aa, Artificial Sequence; identical to SEQ ID NO: 274
  Synthetic polypeptide

SEQ ID NO: 1394 - protein, 139 aa, Artificial Sequence
  Synthetic polypeptide
EVQLLESGGGLVQPGGSLRLSCAASGFTFSVYSMHWVRQAPGKGLEWVSVIGPSGGITLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1395 - protein, 107 aa, Artificial Sequence; identical to SEQ ID NO: 274
  Synthetic polypeptide

SEQ ID NO: 1396 - protein, 139 aa, Artificial Sequence
  Synthetic polypeptide
EVQLLESGGGLVQPGGSLRLSCAASGFTFSRYSMRWVRQAPGKGLEWVSVIYPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1397 - protein, 107 aa, Artificial Sequence; identical to SEQ ID NO: 274
  Synthetic polypeptide

SEQ ID NO: 1398 - protein, 139 aa, Artificial Sequence
  Synthetic polypeptide
EVQLLESGGGLVQPGGSLRLSCAASGFTFSNYSMDWVRQAPGKGLEWVSRIYSSGGGTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1399 - protein, 107 aa, Artificial Sequence; identical to SEQ ID NO: 274
  Synthetic polypeptide

SEQ ID NO: 1400 - protein, 138 aa, Artificial Sequence
  Synthetic polypeptide
EVQLLESGGGLVQPGGSLRLSCAASGFTFSRYVMWWVRQAPGKGLEWVSSISPSGDTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1401 - protein, 107 aa, Artificial Sequence; identical to SEQ ID NO: 274
  Synthetic polypeptide

SEQ ID NO: 1402 - protein, 139 aa, Artificial Sequence
  Synthetic polypeptide
EVQLLESGGGLVQPGGSLRLSCAASGFTFSIYDMIWVRQAPGKGLEWVSSIYPSGGNTSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1403 - protein, 107 aa, Artificial Sequence; identical to SEQ ID NO: 274
  Synthetic polypeptide

SEQ ID NO: 1404 - protein, 139 aa, Artificial Sequence
  Synthetic polypeptide
EVQLLESGGGLVQPGGSLRLSCAASGFTFSIYSMQWVRQAPGKGLEWVSSIGSSGGKTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1405 - protein, 107 aa, Artificial Sequence; identical to SEQ ID NO: 274
  Synthetic polypeptide

SEQ ID NO: 1406 - protein, 139 aa, Artificial Sequence
  Synthetic polypeptide
EVQLLESGGGLVQPGGSLRLSCAASGFTFSVYNMHWVRQAPGKGLEWVSSIYPSGGMTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1407 - protein, 107 aa, Artificial Sequence; identical to SEQ ID NO: 274
  Synthetic polypeptide

SEQ ID NO: 1408 - protein, 139 aa, Artificial Sequence
  Synthetic polypeptide
EVQLLESGGGLVQPGGSLRLSCAASGFTFSPYDMLWVRQAPGKGLEWVSYIVSSGGLTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1409 - protein, 107 aa, Artificial Sequence; identical to SEQ ID NO: 274
  Synthetic polypeptide

SEQ ID NO: 1410 - protein, 139 aa, Artificial Sequence
  Synthetic polypeptide
EVQLLESGGGLVQPGGSLRLSCAASGFTFSTYTMRWVRQAPGKGLEWVSSIYPSGGKTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1411 - protein, 107 aa, Artificial Sequence; identical to SEQ ID NO: 274
  Synthetic polypeptide

SEQ ID NO: 1412 - protein, 139 aa, Artificial Sequence
  Synthetic polypeptide
EVQLLESGGGLVQPGGSLRLSCAASGFTFSIYHMYWVRQAPGKGLEWVSSIGPSGGPTGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1413 - protein, 107 aa, Artificial Sequence; identical to SEQ ID NO: 274
  Synthetic polypeptide

SEQ ID NO: 1414 - protein, 139 aa, Artificial Sequence
  Synthetic polypeptide
EVQLLESGGGLVQPGGSLRLSCAASGFTFSIYSMFWVRQAPGKGLEWVSSIGPSGGVTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1415 - protein, 107 aa, Artificial Sequence; identical to SEQ ID NO: 274
  Synthetic polypeptide

SEQ ID NO: 1416 - protein, 139 aa, Artificial Sequence
  Synthetic polypeptide
EVQLLESGGGLVQPGGSLRLSCAASGFTFSVYAMRWVRQAPGKGLEWVSSIYPSGGKTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1417 - protein, 107 aa, Artificial Sequence; identical to SEQ ID NO: 274
  Synthetic polypeptide

SEQ ID NO: 1418 - protein, 139 aa, Artificial Sequence
  Synthetic polypeptide
EVQLLESGGGLVQPGGSLRLSCAASGFTFSTYAMVWVRQAPGKGLEWVSSIYPSGGITTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1419 - protein, 107 aa, Artificial Sequence; identical to SEQ ID NO: 274
  Synthetic polypeptide

SEQ ID NO: 1420 - protein, 139 aa, Artificial Sequence
  Synthetic polypeptide
EVQLLESGGGLVQPGGSLRLSCAASGFTFSSYNMHWVRQAPGKGLEWVSSIVPSGGKTNYADSVKGRFTISRDNSKNTLYLQMNSLRAEDTAVYYCAYRRTGIPRRDAFDIWGQGTMVTVSSASTKGPSVFPLAPSSKS

SEQ ID NO: 1421 - protein, 107 aa, Artificial Sequence; identical to SEQ ID NO: 274
  Synthetic polypeptide

SEQ ID NO: 1422 - protein, 139 aa, Artificial Sequence
  Synthetic polypeptide
EVQLLESGGGLVQPGGSLRLSCAASGFTFSIYNMIWVRQAPGKGLEWVSSIYPSGGWTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1423 - protein, 107 aa, Artificial Sequence; identical to SEQ ID NO: 274
  Synthetic polypeptide

SEQ ID NO: 1424 - protein, 139 aa, Artificial Sequence
  Synthetic polypeptide
EVQLLESGGGLVQPGGSLRLSCAASGFTFSPYTMIWVRQAPGKGLEWVSSISSSGGMTPYADSVKGRFTISRDNSKNTLYLQMNSLRAEDTAVYYCAYRRTGIPRRDAFDIWGQGTMVTVSSASTKGPSVFPLAPSSKS

SEQ ID NO: 1425 - protein, 107 aa, Artificial Sequence; identical to SEQ ID NO: 274
  Synthetic polypeptide

SEQ ID NO: 1426 - protein, 139 aa, Artificial Sequence
  Synthetic polypeptide
EVQLLESGGGLVQPGGSLRLSCAASGFTFSRYSMIWVRQAPGKGLEWVSSIWSSGGATEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1427 - protein, 107 aa, Artificial Sequence; identical to SEQ ID NO: 274
  Synthetic polypeptide

SEQ ID NO: 1428 - protein, 139 aa, Artificial Sequence
  Synthetic polypeptide
EVQLLESGGGLVQPGGSLRLSCAASGFTFSIYSMHWVRQAPGKGLEWVSSIYSSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1429 - protein, 107 aa, Artificial Sequence; identical to SEQ ID NO: 274
  Synthetic polypeptide

SEQ ID NO: 1430 - protein, 139 aa, Artificial Sequence
  Synthetic polypeptide
EVQLLESGGGLVQPGGSLRLSCAASGFTFSRYQMHWVRQAPGKGLEWVSWISPSGGITGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1431 - protein, 107 aa, Artificial Sequence; identical to SEQ ID NO: 274
  Synthetic polypeptide

SEQ ID NO: 1432 - protein, 138 aa, Artificial Sequence
  Synthetic polypeptide
EVQLLESGGGLVQPGGSLRLSCAASGFTFSWYMMQWVRQAPGKGLEWVSRISPSGGTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1433 - protein, 107 aa, Artificial Sequence; identical to SEQ ID NO: 274
  Synthetic polypeptide

SEQ ID NO: 1434 - protein, 139 aa, Artificial Sequence
  Synthetic polypeptide
EVQLLESGGGLVQPGGSLRLSCAASGFTFSIYFMSWVRQAPGKGLEWVSSIRSSGGPTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1435 - protein, 107 aa, Artificial Sequence; identical to SEQ ID NO: 274
  Synthetic polypeptide

SEQ ID NO: 1436 - protein, 139 aa, Artificial Sequence
  Synthetic polypeptide
EVQLLESGGGLVQPGGSLRLSCAASGFTFSVYSMTWVRQAPGKGLEWVSSIGSSGGSTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1437 - protein, 107 aa, Artificial Sequence; identical to SEQ ID NO: 274
  Synthetic polypeptide

SEQ ID NO: 1438 - protein, 139 aa, Artificial Sequence
  Synthetic polypeptide
EVQLLESGGGLVQPGGSLRLSCAASGFTFSKYSMAWVRQAPGKGLEWVSGIYPSGGRTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1439 - protein, 107 aa, Artificial Sequence; identical to SEQ ID NO: 274
  Synthetic polypeptide

SEQ ID NO: 1440 - protein, 139 aa, Artificial Sequence
  Synthetic polypeptide
EVQLLESGGGLVQPGGSLRLSCAASGFTFSRYSMSWVRQAPGKGLEWVSGISPSGGETSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1441 - protein, 107 aa, Artificial Sequence; identical to SEQ ID NO: 274
  Synthetic polypeptide

SEQ ID NO: 1442 - protein, 139 aa, Artificial Sequence
  Synthetic polypeptide
EVQLLESGGGLVQPGGSLRLSCAASGFTFSRYKMYWVRQAPGKGLEWVSVIGPSGGATFYADSVKGRFTISRDNSKNTLYLQMNSLRAEDTAVYYCAYRRTGIPRRDAFDIWGQGTMVTVSSASTKGPSVFPLAPSSKS

SEQ ID NO: 1443 - protein, 107 aa, Artificial Sequence; identical to SEQ ID NO: 274
  Synthetic polypeptide

SEQ ID NO: 1444 - protein, 139 aa, Artificial Sequence
  Synthetic polypeptide
EVQLLESGGGLVQPGGSLRLSCAASGFTFSQYFMHWVRQAPGKGLEWVSYIYPSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1445 - protein, 107 aa, Artificial Sequence; identical to SEQ ID NO: 274
  Synthetic polypeptide

SEQ ID NO: 1446 - protein, 139 aa, Artificial Sequence
  Synthetic polypeptide
EVQLLESGGGLVQPGGSLRLSCAASGFTFSIYTMYWVRQAPGKGLEWVSSISPSGGWTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1447 - protein, 107 aa, Artificial Sequence; identical to SEQ ID NO: 274
  Synthetic polypeptide

SEQ ID NO: 1448 - protein, 140 aa, Artificial Sequence
  Synthetic polypeptide
EVQLLESGGGLVQPGGSLRLSCAASGFTFSHYMGMNWVRQAPGKGLEWVSSIVPSGGWTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1449 - protein, 107 aa, Artificial Sequence; identical to SEQ ID NO: 274
  Synthetic polypeptide

SEQ ID NO: 1450 - protein, 139 aa, Artificial Sequence
  Synthetic polypeptide
EVQLLESGGGLVQPGGSLRLSCAASGFTFSLYVMYWVRQAPGKGLEWVSYIVPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1451 - protein, 107 aa, Artificial Sequence; identical to SEQ ID NO: 274
  Synthetic polypeptide

SEQ ID NO: 1452 - protein, 139 aa, Artificial Sequence
  Synthetic polypeptide
EVQLLESGGGLVQPGGSLRLSCAASGFTFSIYSMYWVRQAPGKGLEWVSYIRPSGGNTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1453 - protein, 107 aa, Artificial Sequence; identical to SEQ ID NO: 274
  Synthetic polypeptide

SEQ ID NO: 1454 - protein, 139 aa, Artificial Sequence
  Synthetic polypeptide
EVQLLESGGGLVQPGGSLRLSCAASGFTFSIYDMNWVRQAPGKGLEWVSSIYPSGGRTRYADSVKGRFTISRDNSKNTLYLQMNSLRAEDTAVYYCAYRRTGIPRRDAFDIWGQGTMVTVSSASTKGPSVFPLAPSSKS

SEQ ID NO: 1455 - protein, 107 aa, Artificial Sequence; identical to SEQ ID NO: 274
  Synthetic polypeptide

SEQ ID NO: 1456 - protein, 139 aa, Artificial Sequence
  Synthetic polypeptide
EVQLLESGGGLVQPGGSLRLSCAASGFTFSTYSMYWVRQAPGKGLEWVSSIYPSGGLTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1457 - protein, 107 aa, Artificial Sequence; identical to SEQ ID NO: 274
  Synthetic polypeptide

SEQ ID NO: 1458 - protein, 139 aa, Artificial Sequence
  Synthetic polypeptide
EVQLLESGGGLVQPGGSLRLSCAASGFTFSIYDMWWVRQAPGKGLEWVSSIRPSGGITKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1459 - protein, 107 aa, Artificial Sequence; identical to SEQ ID NO: 274
  Synthetic polypeptide

SEQ ID NO: 1460 - protein, 139 aa, Artificial Sequence
  Synthetic polypeptide
EVQLLESGGGLVQPGGSLRLSCAASGFTFSVYSMWWVRQAPGKGLEWVSSISSSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1461 - protein, 107 aa, Artificial Sequence; identical to SEQ ID NO: 274
  Synthetic polypeptide

SEQ ID NO: 1462 - protein, 139 aa, Artificial Sequence
  Synthetic polypeptide
EVQLLESGGGLVQPGGSLRLSCAASGFTFSVYNMHWVRQAPGKGLEWVSSIYPSGGMTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1463 - protein, 107 aa, Artificial Sequence; identical to SEQ ID NO: 274
  Synthetic polypeptide

SEQ ID NO: 1464 - protein, 139 aa, Artificial Sequence
  Synthetic polypeptide
EVQLLESGGGLVQPGGSLRLSCAASGFTFSIYTMMWVRQAPGKGLEWVSSIWSSGGQTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1465 - protein, 107 aa, Artificial Sequence; identical to SEQ ID NO: 274
  Synthetic polypeptide

SEQ ID NO: 1466 - protein, 137 aa, Artificial Sequence
  Synthetic polypeptide
EVQLLESGGGLVQPGGSLRLSCAASGFTFSQYTMVWVRQAPGKGLEWVSWIYSSRANYADSVKGRFTISRDNSKNTLYLQMNSLRAEDTAVYYCAYRRTGIPRRDAFDIWGQGTMVTVSSASTKGPSVFPLAPSSKS

SEQ ID NO: 1467 - protein, 107 aa, Artificial Sequence; identical to SEQ ID NO: 274
  Synthetic polypeptide

SEQ ID NO: 1468 - protein, 139 aa, Artificial Sequence
  Synthetic polypeptide
EVQLLESGGGLVQPGGSLRLSCAASGFTFSIYDMTWVRQAPGKGLEWVSSIYPSGGQTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1469 - protein, 107 aa, Artificial Sequence; identical to SEQ ID NO: 274
  Synthetic polypeptide

SEQ ID NO: 1470 - protein, 138 aa, Artificial Sequence
  Synthetic polypeptide
EVQLLESGGGLVQPGGSLRLSCAASGFTFSPYNMYWVRQAPGKGLEWVSWIVPGGVTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1471 - protein, 107 aa, Artificial Sequence; identical to SEQ ID NO: 274
  Synthetic polypeptide

SEQ ID NO: 1472 - protein, 139 aa, Artificial Sequence
  Synthetic polypeptide
EVQLLESGGGLVQPGGSLRLSCAASGFTFSIYDMYWVRQAPGKGLEWVSSIGPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1473 - protein, 107 aa, Artificial Sequence; identical to SEQ ID NO: 274
  Synthetic polypeptide

SEQ ID NO: 1474 - protein, 139 aa, Artificial Sequence
  Synthetic polypeptide
EVQLLESGGGLVQPGGSLRLSCAASGFTFSIYLMIWVRQAPGKGLEWVSYIGPSGGPTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1475 - protein, 107 aa, Artificial Sequence; identical to SEQ ID NO: 274
  Synthetic polypeptide

SEQ ID NO: 1476 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKS

SEQ ID NO: 1477 - protein, 107 aa, Artificial Sequence; identical to SEQ ID NO: 274
  Synthetic polypeptide

SEQ ID NO: 1478 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGIPRRDAFDIWGQGTMVTVSSASTKGPSVFPLAPSSKS

SEQ ID NO: 1479 - protein, 107 aa, Artificial Sequence; identical to SEQ ID NO: 274
  Synthetic polypeptide

SEQ ID NO: 1480 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDAFDNWGQGTMVTVSSASTKGPSVFPLAPSSKS

SEQ ID NO: 1481 - protein, 107 aa, Artificial Sequence; identical to SEQ ID NO: 274
  Synthetic polypeptide

SEQ ID NO: 1482 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDSFDIWGQGTMVTVSSASTKGPSVFPLAPSSKS

SEQ ID NO: 1483 - protein, 107 aa, Artificial Sequence; identical to SEQ ID NO: 274
  Synthetic polypeptide

SEQ ID NO: 1484 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDSWGQGTMVTVSSASTKGPSVFPLAPSSKS

SEQ ID NO: 1485 - protein, 107 aa, Artificial Sequence; identical to SEQ ID NO: 274
  Synthetic polypeptide

SEQ ID NO: 1486 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAWRRIGVPRRDSFDMWGQGTMVTVSSASTKGPSVFPLAPSSKS

SEQ ID NO: 1487 - protein, 107 aa, Artificial Sequence; identical to SEQ ID NO: 274
  Synthetic polypeptide

SEQ ID NO: 1488 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDNWGQGTMVTVSSASTKGPSVFPLAPSSKS

SEQ ID NO: 1489 - protein, 107 aa, Artificial Sequence; identical to SEQ ID NO: 274
  Synthetic polypeptide

SEQ ID NO: 1490 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRMGIPRRNAFDIWGQGTMVTVSSASTKGPSVFPLAPSSKS

SEQ ID NO: 1491 - protein, 107 aa, Artificial Sequence; identical to SEQ ID NO: 274
  Synthetic polypeptide

SEQ ID NO: 1492 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRNAFDNWGQGTMVTVSSASTKGPSVFPLAPSSKS

SEQ ID NO: 1493 - protein, 107 aa, Artificial Sequence; identical to SEQ ID NO: 274
  Synthetic polypeptide

SEQ ID NO: 1494 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDVFDIWGQGTMVTVSSASTKGPSVFPLAPSSKS

SEQ ID NO: 1495 - protein, 107 aa, Artificial Sequence; identical to SEQ ID NO: 274
  Synthetic polypeptide

SEQ ID NO: 1496 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDEFDIWGQGTMVTVSSASTKGPSVFPLAPSSKS

SEQ ID NO: 1497 - protein, 107 aa, Artificial Sequence; identical to SEQ ID NO: 274
  Synthetic polypeptide

SEQ ID NO: 1498 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGIPRRDAFDIWGQGTMVTVSSASTKGPSVFPLAPSSKS

SEQ ID NO: 1499 - protein, 107 aa, Artificial Sequence; identical to SEQ ID NO: 274
  Synthetic polypeptide

SEQ ID NO: 1500 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDIWGQGTMVTVSSASTKGPSVFPLAPSSKS

SEQ ID NO: 1501 - protein, 107 aa, Artificial Sequence; identical to SEQ ID NO: 274
  Synthetic polypeptide

SEQ ID NO: 1502 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDALDNWGQGTMVTVSSASTKGPSVFPLAPSSKS

SEQ ID NO: 1503 - protein, 107 aa, Artificial Sequence; identical to SEQ ID NO: 274
  Synthetic polypeptide

SEQ ID NO: 1504 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDAFDIWGQGTMVTVSSASTKGPSVFPLAPSSKS

SEQ ID NO: 1505 - protein, 107 aa, Artificial Sequence; identical to SEQ ID NO: 274
  Synthetic polypeptide

SEQ ID NO: 1506 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRKGIPRRDDFDIWGQGTMVTVSSASTKGPSVFPLAPSSKS

SEQ ID NO: 1507 - protein, 107 aa, Artificial Sequence; identical to SEQ ID NO: 274
  Synthetic polypeptide

SEQ ID NO: 1508 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRWDAFDIWGQGTMVTVSSASTKGPSVFPLAPSSKS

SEQ ID NO: 1509 - protein, 107 aa, Artificial Sequence; identical to SEQ ID NO: 274
  Synthetic polypeptide

SEQ ID NO: 1510 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDSFDIWGQGTMVTVSSASTKGPSVFPLAPSSKS

SEQ ID NO: 1511 - protein, 107 aa, Artificial Sequence; identical to SEQ ID NO: 274
  Synthetic polypeptide

SEQ ID NO: 1512 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYQRTGVPRRDSFNIWGQGTMVTVSSASTKGPSVFPLAPSSKS

SEQ ID NO: 1513 - protein, 107 aa, Artificial Sequence; identical to SEQ ID NO: 274
  Synthetic polypeptide

SEQ ID NO: 1514 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDDFDIWGQGTMVTVSSASTKGPSVFPLAPSSKS

SEQ ID NO: 1515 - protein, 107 aa, Artificial Sequence; identical to SEQ ID NO: 274
  Synthetic polypeptide

SEQ ID NO: 1516 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGVPRRDDFDIWGQGTMVTVSSASTKGPSVFPLAPSSKS

SEQ ID NO: 1517 - protein, 107 aa, Artificial Sequence; identical to SEQ ID NO: 274
  Synthetic polypeptide

SEQ ID NO: 1518 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDDFDIWGQGTMVTVSSASTKGPSVFPLAPSSKS

SEQ ID NO: 1519 - protein, 107 aa, Artificial Sequence; identical to SEQ ID NO: 274
  Synthetic polypeptide

SEQ ID NO: 1520 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRPGVPRRDAFDIWGQGTMVTVSSASTKGPSVFPLAPSSKS

SEQ ID NO: 1521 - protein, 107 aa, Artificial Sequence; identical to SEQ ID NO: 274
  Synthetic polypeptide

SEQ ID NO: 1522 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDDFDIWGQGTMVTVSSASTKGPSVFPLAPSSKS

SEQ ID NO: 1523 - protein, 107 aa, Artificial Sequence; identical to SEQ ID NO: 274
  Synthetic polypeptide

SEQ ID NO: 1524 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDSFDIWGQGTMVTVSSASTKGPSVFPLAPSSKS

SEQ ID NO: 1525 - protein, 107 aa, Artificial Sequence; identical to SEQ ID NO: 274
  Synthetic polypeptide

SEQ ID NO: 1526 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFEIWGQGTMVTVSSASTKGPSVFPLAPSSKS

SEQ ID NO: 1527 - protein, 107 aa, Artificial Sequence; identical to SEQ ID NO: 274
  Synthetic polypeptide

SEQ ID NO: 1528 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGVPRRDDFDIWGQGTMVTVSSASTKGPSVFPLAPSSKS

SEQ ID NO: 1529 - protein, 107 aa, Artificial Sequence; identical to SEQ ID NO: 274
  Synthetic polypeptide

SEQ ID NO: 1530 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDAFDIWGQGTMVTVSSASTKGPSVFPLAPSSKS

SEQ ID NO: 1531 - protein, 107 aa, Artificial Sequence; identical to SEQ ID NO: 274
  Synthetic polypeptide

SEQ ID NO: 1532 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDSFEIWGQGTMVTVSSASTKGPSVFPLAPSSKS

SEQ ID NO: 1533 - protein, 107 aa, Artificial Sequence; identical to SEQ ID NO: 274
  Synthetic polypeptide

SEQ ID NO: 1534 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRWDDFDIWGQGTMVTVSSASTKGPSVFPLAPSSKS

SEQ ID NO: 1535 - protein, 107 aa, Artificial Sequence; identical to SEQ ID NO: 274
  Synthetic polypeptide

SEQ ID NO: 1536 - protein, 139 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDVFDIWGQGTMVTVSSASTKGPSVFPLAPSSKS

SEQ ID NO: 1537 - protein, 12 aa, Artificial Sequence
  Synthetic polypeptide
RTSQFVNSNYLA

SEQ ID NO: 1538 - protein, 7 aa, Artificial Sequence
  Synthetic polypeptide
GASSRAT

SEQ ID NO: 1539 - protein, 9 aa, Artificial Sequence
  Synthetic polypeptide
QQSSRTPWT

SEQ ID NO: 1540 - protein, 5 aa, Artificial Sequence
  Synthetic polypeptide
HYLMT

SEQ ID NO: 1541 - protein, 5 aa, Artificial Sequence
  Synthetic polypeptide
HYLMT

SEQ ID NO: 1542 - protein, 5 aa, Artificial Sequence
  Synthetic polypeptide
DYMMA

SEQ ID NO: 1543 - protein, 5 aa, Artificial Sequence
  Synthetic polypeptide
HYLMT

SEQ ID NO: 1544 - protein, 5 aa, Artificial Sequence
  Synthetic polypeptide
HYLMT

SEQ ID NO: 1545 - protein, 5 aa, Artificial Sequence
  Synthetic polypeptide
QYLMA

SEQ ID NO: 1546 - protein, 5 aa, Artificial Sequence
  Synthetic polypeptide
HYLMT

SEQ ID NO: 1547 - protein, 5 aa, Artificial Sequence
  Synthetic polypeptide
HYLMT

SEQ ID NO: 1548 - protein, 5 aa, Artificial Sequence
  Synthetic polypeptide
HYLMT

SEQ ID NO: 1549 - protein, 5 aa, Artificial Sequence
  Synthetic polypeptide
HYLMT

SEQ ID NO: 1550 - protein, 5 aa, Artificial Sequence
  Synthetic polypeptide
HYLMT

SEQ ID NO: 1551 - protein, 5 aa, Artificial Sequence
  Synthetic polypeptide
HYLMT

SEQ ID NO: 1552 - protein, 5 aa, Artificial Sequence
  Synthetic polypeptide
HYLMT

SEQ ID NO: 1553 - protein, 5 aa, Artificial Sequence
  Synthetic polypeptide
NYMMG

SEQ ID NO: 1554 - protein, 5 aa, Artificial Sequence
  Synthetic polypeptide
HYLMT

SEQ ID NO: 1555 - protein, 5 aa, Artificial Sequence
  Synthetic polypeptide
GYMMV

SEQ ID NO: 1556 - protein, 5 aa, Artificial Sequence
  Synthetic polypeptide
HYLMT

SEQ ID NO: 1557 - protein, 5 aa, Artificial Sequence
  Synthetic polypeptide
HYLMT

SEQ ID NO: 1558 - protein, 5 aa, Artificial Sequence
  Synthetic polypeptide
HYLMT

SEQ ID NO: 1559 - protein, 5 aa, Artificial Sequence
  Synthetic polypeptide
TYKMQ

SEQ ID NO: 1560 - protein, 5 aa, Artificial Sequence
  Synthetic polypeptide
HYLMT

SEQ ID NO: 1561 - protein, 5 aa, Artificial Sequence
  Synthetic polypeptide
HYLMT

SEQ ID NO: 1562 - protein, 5 aa, Artificial Sequence
  Synthetic polypeptide
HYLMT

SEQ ID NO: 1563 - protein, 5 aa, Artificial Sequence
  Synthetic polypeptide
HYLMT

SEQ ID NO: 1564 - protein, 5 aa, Artificial Sequence
  Synthetic polypeptide
HYLMT

SEQ ID NO: 1565 - protein, 5 aa, Artificial Sequence
  Synthetic polypeptide
DYMMT

SEQ ID NO: 1566 - protein, 5 aa, Artificial Sequence
  Synthetic polypeptide
EYMMV

SEQ ID NO: 1567 - protein, 5 aa, Artificial Sequence
  Synthetic polypeptide
HYLMT

SEQ ID NO: 1568 - protein, 5 aa, Artificial Sequence
  Synthetic polypeptide
VYMMS

SEQ ID NO: 1569 - protein, 5 aa, Artificial Sequence
  Synthetic polypeptide
HYLMT

SEQ ID NO: 1570 - protein, 5 aa, Artificial Sequence
  Synthetic polypeptide
HYLMT

SEQ ID NO: 1571 - protein, 5 aa, Artificial Sequence
  Synthetic polypeptide
QYMMM

SEQ ID NO: 1572 - protein, 5 aa, Artificial Sequence
  Synthetic polypeptide
DYMMM

SEQ ID NO: 1573 - protein, 5 aa, Artificial Sequence
  Synthetic polypeptide
HYLMT

SEQ ID NO: 1574 - protein, 5 aa, Artificial Sequence
  Synthetic polypeptide
HYLMT

SEQ ID NO: 1575 - protein, 5 aa, Artificial Sequence
  Synthetic polypeptide
HYLMT

SEQ ID NO: 1576 - protein, 5 aa, Artificial Sequence
  Synthetic polypeptide
TYMMQ

SEQ ID NO: 1577 - protein, 5 aa, Artificial Sequence
  Synthetic polypeptide
HYLMT

SEQ ID NO: 1578 - protein, 5 aa, Artificial Sequence
  Synthetic polypeptide
GYKMQ

SEQ ID NO: 1579 - protein, 5 aa, Artificial Sequence
  Synthetic polypeptide
HYLMT

SEQ ID NO: 1580 - protein, 5 aa, Artificial Sequence
  Synthetic polypeptide
TYLMA

SEQ ID NO: 1581 - protein, 5 aa, Artificial Sequence
  Synthetic polypeptide
HYLMT

SEQ ID NO: 1582 - protein, 5 aa, Artificial Sequence
  Synthetic polypeptide
NYTMG

SEQ ID NO: 1583 - protein, 5 aa, Artificial Sequence
  Synthetic polypeptide
EYMMM

SEQ ID NO: 1584 - protein, 5 aa, Artificial Sequence
  Synthetic polypeptide
NYTMQ

SEQ ID NO: 1585 - protein, 5 aa, Artificial Sequence
  Synthetic polypeptide
HYLMT

SEQ ID NO: 1586 - protein, 5 aa, Artificial Sequence
  Synthetic polypeptide
HYLMT

SEQ ID NO: 1587 - protein, 5 aa, Artificial Sequence
  Synthetic polypeptide
HYLMT

SEQ ID NO: 1588 - protein, 5 aa, Artificial Sequence
  Synthetic polypeptide
HYLMT

SEQ ID NO: 1589 - protein, 5 aa, Artificial Sequence
  Synthetic polypeptide
HYLMT

SEQ ID NO: 1590 - protein, 5 aa, Artificial Sequence
  Synthetic polypeptide
NYDMI

SEQ ID NO: 1591 - protein, 5 aa, Artificial Sequence
  Synthetic polypeptide
VYMMI

SEQ ID NO: 1592 - protein, 5 aa, Artificial Sequence
  Synthetic polypeptide
HYLMT

SEQ ID NO: 1593 - protein, 5 aa, Artificial Sequence
  Synthetic polypeptide
HYLMT

SEQ ID NO: 1594 - protein, 5 aa, Artificial Sequence
  Synthetic polypeptide
QYMMV

SEQ ID NO: 1595 - protein, 5 aa, Artificial Sequence
  Synthetic polypeptide
HYLMT

SEQ ID NO: 1596 - protein, 5 aa, Artificial Sequence
  Synthetic polypeptide
QYDMI

SEQ ID NO: 1597 - protein, 5 aa, Artificial Sequence
  Synthetic polypeptide
SQQMV

SEQ ID NO: 1598 - protein, 5 aa, Artificial Sequence
  Synthetic polypeptide
NYLMA

SEQ ID NO: 1599 - protein, 5 aa, Artificial Sequence
  Synthetic polypeptide
HYLMT

SEQ ID NO: 1600 - protein, 5 aa, Artificial Sequence
  Synthetic polypeptide
HYLMT

SEQ ID NO: 1601 - protein, 5 aa, Artificial Sequence
  Synthetic polypeptide
SYMMV

SEQ ID NO: 1602 - protein, 17 aa, Artificial Sequence
  Synthetic polypeptide
YISPSGGHTIYADSVKG

SEQ ID NO: 1603 - protein, 17 aa, Artificial Sequence
  Synthetic polypeptide
YISPSGGHTIYADSVKG

SEQ ID NO: 1604 - protein, 17 aa, Artificial Sequence
  Synthetic polypeptide
SIVPSGGHTHYADSVKG

SEQ ID NO: 1605 - protein, 17 aa, Artificial Sequence
  Synthetic polypeptide
YISPSGGHTIYADSVKG

SEQ ID NO: 1606 - protein, 17 aa, Artificial Sequence
  Synthetic polypeptide
YISPSGGHTIYADSVKG

SEQ ID NO: 1607 - protein, 17 aa, Artificial Sequence
  Synthetic polypeptide
SIYPSGGWTKYADSVKG

SEQ ID NO: 1608 - protein, 17 aa, Artificial Sequence
  Synthetic polypeptide
YISPSGGHTIYADSVKG

SEQ ID NO: 1609 - protein, 17 aa, Artificial Sequence
  Synthetic polypeptide
YISPSGGHTIYADSVKG

SEQ ID NO: 1610 - protein, 17 aa, Artificial Sequence
  Synthetic polypeptide
YISPSGGHTIYADSVKG

SEQ ID NO: 1611 - protein, 17 aa, Artificial Sequence
  Synthetic polypeptide
YISPSGGHTIYADSVKG

SEQ ID NO: 1612 - protein, 17 aa, Artificial Sequence
  Synthetic polypeptide
YISPSGGHTIYADSVKG

SEQ ID NO: 1613 - protein, 17 aa, Artificial Sequence
  Synthetic polypeptide
YISPSGGHTIYADSVKG

SEQ ID NO: 1614 - protein, 17 aa, Artificial Sequence
  Synthetic polypeptide
YISPSGGHTIYADSVKG

SEQ ID NO: 1615 - protein, 17 aa, Artificial Sequence
  Synthetic polypeptide
SISPSGGLTKYADSVKG

SEQ ID NO: 1616 - protein, 17 aa, Artificial Sequence
  Synthetic polypeptide
YISPSGGHTIYADSVKG

SEQ ID NO: 1617 - protein, 17 aa, Artificial Sequence
  Synthetic polypeptide
RISPSGGPTIYADSVKG

SEQ ID NO: 1618 - protein, 17 aa, Artificial Sequence
  Synthetic polypeptide
YISPSGGHTIYADSVKG

SEQ ID NO: 1619 - protein, 17 aa, Artificial Sequence
  Synthetic polypeptide
YISPSGGHTIYADSVKG

SEQ ID NO: 1620 - protein, 17 aa, Artificial Sequence
  Synthetic polypeptide
YISPSGGHTIYADSVKG

SEQ ID NO: 1621 - protein, 17 aa, Artificial Sequence
  Synthetic polypeptide
SISPSGGPTNYADSVKG

SEQ ID NO: 1622 - protein, 17 aa, Artificial Sequence
  Synthetic polypeptide
YISPSGGHTIYADSVKG

SEQ ID NO: 1623 - protein, 17 aa, Artificial Sequence
  Synthetic polypeptide
YISPSGGHTIYADSVKG

SEQ ID NO: 1624 - protein, 17 aa, Artificial Sequence
  Synthetic polypeptide
YISPSGGHTIYADSVKG

SEQ ID NO: 1625 - protein, 17 aa, Artificial Sequence
  Synthetic polypeptide
YISPSGGHTIYADSVKG

SEQ ID NO: 1626 - protein, 17 aa, Artificial Sequence
  Synthetic polypeptide
YISPSGGHTIYADSVKG

SEQ ID NO: 1627 - protein, 17 aa, Artificial Sequence
  Synthetic polypeptide
YISPSGGLTSYADSVKG

SEQ ID NO: 1628 - protein, 17 aa, Artificial Sequence
  Synthetic polypeptide
RISPSGGTTEYADSVKG

SEQ ID NO: 1629 - protein, 17 aa, Artificial Sequence
  Synthetic polypeptide
YISPSGGHTIYADSVKG

SEQ ID NO: 1630 - protein, 17 aa, Artificial Sequence
  Synthetic polypeptide
SIVPSGGSTTYADSVKG

SEQ ID NO: 1631 - protein, 17 aa, Artificial Sequence
  Synthetic polypeptide
YISPSGGHTIYADSVKG

SEQ ID NO: 1632 - protein, 17 aa, Artificial Sequence
  Synthetic polypeptide
YISPSGGHTIYADSVKG

SEQ ID NO: 1633 - protein, 17 aa, Artificial Sequence
  Synthetic polypeptide
RISPSGGSTLYADSVKG

SEQ ID NO: 1634 - protein, 17 aa, Artificial Sequence
  Synthetic polypeptide
SIVPSGGHTQYADSVKG

SEQ ID NO: 1635 - protein, 17 aa, Artificial Sequence
  Synthetic polypeptide
YISPSGGHTIYADSVKG

SEQ ID NO: 1636 - protein, 17 aa, Artificial Sequence
  Synthetic polypeptide
YISPSGGHTIYADSVKG

SEQ ID NO: 1637 - protein, 17 aa, Artificial Sequence
  Synthetic polypeptide
YISPSGGHTIYADSVKG

SEQ ID NO: 1638 - protein, 17 aa, Artificial Sequence
  Synthetic polypeptide
YIGPSGGKTDYADSVKG

SEQ ID NO: 1639 - protein, 17 aa, Artificial Sequence
  Synthetic polypeptide
YISPSGGHTIYADSVKG

SEQ ID NO: 1640 - protein, 17 aa, Artificial Sequence
  Synthetic polypeptide
SISPSGGITMYADSVKG

SEQ ID NO: 1641 - protein, 17 aa, Artificial Sequence
  Synthetic polypeptide
YISPSGGHTIYADSVKG

SEQ ID NO: 1642 - protein, 17 aa, Artificial Sequence
  Synthetic polypeptide
GIVSSGGRTLYADSVKG

SEQ ID NO: 1643 - protein, 17 aa, Artificial Sequence
  Synthetic polypeptide
YISPSGGHTIYADSVKG

SEQ ID NO: 1644 - protein, 17 aa, Artificial Sequence
  Synthetic polypeptide
SISPSGGKTDYADSVKG

SEQ ID NO: 1645 - protein, 17 aa, Artificial Sequence
  Synthetic polypeptide
VISPSGGQTHYADSVKG

SEQ ID NO: 1646 - protein, 17 aa, Artificial Sequence
  Synthetic polypeptide
YISPSGGYTGYADSVKG

SEQ ID NO: 1647 - protein, 17 aa, Artificial Sequence
  Synthetic polypeptide
YISPSGGHTIYADSVKG

SEQ ID NO: 1648 - protein, 17 aa, Artificial Sequence
  Synthetic polypeptide
YISPSGGHTIYADSVKG

SEQ ID NO: 1649 - protein, 17 aa, Artificial Sequence
  Synthetic polypeptide
YISPSGGHTIYADSVKG

SEQ ID NO: 1650 - protein, 17 aa, Artificial Sequence
  Synthetic polypeptide
YISPSGGHTIYADSVKG

SEQ ID NO: 1651 - protein, 17 aa, Artificial Sequence
  Synthetic polypeptide
YISPSGGHTIYADSVKG

SEQ ID NO: 1652 - protein, 17 aa, Artificial Sequence
  Synthetic polypeptide
SISSSGGTTKYADSVKG

SEQ ID NO: 1653 - protein, 17 aa, Artificial Sequence
  Synthetic polypeptide
SISPSGGQTTYADSVKG

SEQ ID NO: 1654 - protein, 17 aa, Artificial Sequence
  Synthetic polypeptide
YISPSGGHTIYADSVKG

SEQ ID NO: 1655 - protein, 17 aa, Artificial Sequence
  Synthetic polypeptide
YISPSGGHTIYADSVKG

SEQ ID NO: 1656 - protein, 17 aa, Artificial Sequence
  Synthetic polypeptide
SIYSSGGNTPYADSVKG

SEQ ID NO: 1657 - protein, 17 aa, Artificial Sequence
  Synthetic polypeptide
YISPSGGHTIYADSVKG

SEQ ID NO: 1658 - protein, 17 aa, Artificial Sequence
  Synthetic polypeptide
YISSSGGFTRYADSVKG

SEQ ID NO: 1659 - protein, 17 aa, Artificial Sequence
  Synthetic polypeptide
YISPSGGNTYYADSVKG

SEQ ID NO: 1660 - protein, 17 aa, Artificial Sequence
  Synthetic polypeptide
WIVPSGGYTEYADSVKG

SEQ ID NO: 1661 - protein, 17 aa, Artificial Sequence
  Synthetic polypeptide
YISPSGGHTIYADSVKG

SEQ ID NO: 1662 - protein, 17 aa, Artificial Sequence
  Synthetic polypeptide
YISPSGGHTIYADSVKG

SEQ ID NO: 1663 - protein, 17 aa, Artificial Sequence
  Synthetic polypeptide
SISPSGGYTIQADSVKG

SEQ ID NO: 1664 - protein, 16 aa, Artificial Sequence
  Synthetic polypeptide
VARGIAARSRTSYLDQ

SEQ ID NO: 1665 - protein, 16 aa, Artificial Sequence
  Synthetic polypeptide
VGQGIRGRSRTSYFAQ

SEQ ID NO: 1666 - protein, 16 aa, Artificial Sequence
  Synthetic polypeptide
VARGIAARSRTSYFDY

SEQ ID NO: 1667 - protein, 16 aa, Artificial Sequence
  Synthetic polypeptide
VAQGIAARSRTSSVDQ

SEQ ID NO: 1668 - protein, 16 aa, Artificial Sequence
  Synthetic polypeptide
VARGIAARSRTSFFDY

SEQ ID NO: 1669 - protein, 16 aa, Artificial Sequence
  Synthetic polypeptide
VARGIAARSRTSYFDY

SEQ ID NO: 1670 - protein, 16 aa, Artificial Sequence
  Synthetic polypeptide
VARGIASRSRTRYCDY

SEQ ID NO: 1671 - protein, 16 aa, Artificial Sequence
  Synthetic polypeptide
VATGIVARSRTRYFDQ

SEQ ID NO: 1672 - protein, 16 aa, Artificial Sequence
  Synthetic polypeptide
VARGIAARSRTRYFDY

SEQ ID NO: 1673 - protein, 16 aa, Artificial Sequence
  Synthetic polypeptide
VAQGISARSRTSYFDY

SEQ ID NO: 1674 - protein, 16 aa, Artificial Sequence
  Synthetic polypeptide
VAQGIVARSRTSYLHQ

SEQ ID NO: 1675 - protein, 16 aa, Artificial Sequence
  Synthetic polypeptide
VGRGIAARSRTSQLDY

SEQ ID NO: 1676 - protein, 16 aa, Artificial Sequence
  Synthetic polypeptide
VARGIAARSRTSYLDY

SEQ ID NO: 1677 - protein, 16 aa, Artificial Sequence
  Synthetic polypeptide
VARGIAARSRTSYFDY

SEQ ID NO: 1678 - protein, 16 aa, Artificial Sequence
  Synthetic polypeptide
VARGIAARSRTRYFDQ

SEQ ID NO: 1679 - protein, 16 aa, Artificial Sequence
  Synthetic polypeptide
VARGIAARSRTSYFDY

SEQ ID NO: 1680 - protein, 16 aa, Artificial Sequence
  Synthetic polypeptide
VARGIAARSRTSYFDQ

SEQ ID NO: 1681 - protein, 16 aa, Artificial Sequence
  Synthetic polypeptide
VARGIAARSRTILLDQ

SEQ ID NO: 1682 - protein, 16 aa, Artificial Sequence
  Synthetic polypeptide
VARGIAARSRTSFIDY

SEQ ID NO: 1683 - protein, 16 aa, Artificial Sequence
  Synthetic polypeptide
VARGIAARSRTSYFDY

SEQ ID NO: 1684 - protein, 16 aa, Artificial Sequence
  Synthetic polypeptide
VARGIAARSRTSYLDF

SEQ ID NO: 1685 - protein, 16 aa, Artificial Sequence
  Synthetic polypeptide
VARGIAARSRTRSFDY

SEQ ID NO: 1686 - protein, 16 aa, Artificial Sequence
  Synthetic polypeptide
VARGIAARSRTSYFNQ

SEQ ID NO: 1687 - protein, 16 aa, Artificial Sequence
  Synthetic polypeptide
VARGIAARSRTSFFDQ

SEQ ID NO: 1688 - protein, 16 aa, Artificial Sequence
  Synthetic polypeptide
VARGIAARSRTSYFDT

SEQ ID NO: 1689 - protein, 16 aa, Artificial Sequence
  Synthetic polypeptide
VARGIAARSRTSYFDY

SEQ ID NO: 1690 - protein, 16 aa, Artificial Sequence
  Synthetic polypeptide
VARGIAARSRTSYFDY

SEQ ID NO: 1691 - protein, 16 aa, Artificial Sequence
  Synthetic polypeptide
VARGIAARSRTRYIDQ

SEQ ID NO: 1692 - protein, 16 aa, Artificial Sequence
  Synthetic polypeptide
VARGIAARSRTSYFDY

SEQ ID NO: 1693 - protein, 16 aa, Artificial Sequence
  Synthetic polypeptide
VARGIAYRRRTSYFDY

SEQ ID NO: 1694 - protein, 16 aa, Artificial Sequence
  Synthetic polypeptide
VARGIADRSRTSYSDY

SEQ ID NO: 1695 - protein, 16 aa, Artificial Sequence
  Synthetic polypeptide
VARGIAARSRTSYFDY

SEQ ID NO: 1696 - protein, 16 aa, Artificial Sequence
  Synthetic polypeptide
VARGIAARSRTSYFDY

SEQ ID NO: 1697 - protein, 16 aa, Artificial Sequence
  Synthetic polypeptide
VARGIAARSRNSQQDY

SEQ ID NO: 1698 - protein, 16 aa, Artificial Sequence
  Synthetic polypeptide
VARGIAARSRTSYFDQ

SEQ ID NO: 1699 - protein, 16 aa, Artificial Sequence
  Synthetic polypeptide
VARGIAARSRTVYFDH

SEQ ID NO: 1700 - protein, 16 aa, Artificial Sequence
  Synthetic polypeptide
VARGIAARSRTSYFDY

SEQ ID NO: 1701 - protein, 16 aa, Artificial Sequence
  Synthetic polypeptide
VAQGIAARSRTTQFDY

SEQ ID NO: 1702 - protein, 16 aa, Artificial Sequence
  Synthetic polypeptide
VARGIAARSRTSYFDY

SEQ ID NO: 1703 - protein, 16 aa, Artificial Sequence
  Synthetic polypeptide
VGRGIAARSRTSFFDQ

SEQ ID NO: 1704 - protein, 16 aa, Artificial Sequence
  Synthetic polypeptide
VARGIAARSRTSYFDY

SEQ ID NO: 1705 - protein, 16 aa, Artificial Sequence
  Synthetic polypeptide
VARGIAARSRTSQFDH

SEQ ID NO: 1706 - protein, 16 aa, Artificial Sequence
  Synthetic polypeptide
VARGIAARSRTSYFDY

SEQ ID NO: 1707 - protein, 16 aa, Artificial Sequence
  Synthetic polypeptide
VARGIAARSRTSYFDY

SEQ ID NO: 1708 - protein, 16 aa, Artificial Sequence
  Synthetic polypeptide
VARGIAARSRTSYFDY

SEQ ID NO: 1709 - protein, 16 aa, Artificial Sequence
  Synthetic polypeptide
VARGIAARSRTINLDY

SEQ ID NO: 1710 - protein, 16 aa, Artificial Sequence
  Synthetic polypeptide
VARGIAARQRTSYYDY

SEQ ID NO: 1711 - protein, 16 aa, Artificial Sequence
  Synthetic polypeptide
VAQGISGRSRLSYVDY

SEQ ID NO: 1712 - protein, 16 aa, Artificial Sequence
  Synthetic polypeptide
VARGIAARSRTSQFDY

SEQ ID NO: 1713 - protein, 16 aa, Artificial Sequence
  Synthetic polypeptide
VARGITARSRTSYFDD

SEQ ID NO: 1714 - protein, 16 aa, Artificial Sequence
  Synthetic polypeptide
VARGIAARSRTSYFDY

SEQ ID NO: 1715 - protein, 16 aa, Artificial Sequence
  Synthetic polypeptide
VARGIAARSRTSYFDY

SEQ ID NO: 1716 - protein, 16 aa, Artificial Sequence
  Synthetic polypeptide
QARGIAARSRTSYFDY

SEQ ID NO: 1717 - protein, 16 aa, Artificial Sequence
  Synthetic polypeptide
VARGISARSRTSCFDY

SEQ ID NO: 1718 - protein, 16 aa, Artificial Sequence
  Synthetic polypeptide
VARGIAARSRTSYFDY

SEQ ID NO: 1719 - protein, 16 aa, Artificial Sequence
  Synthetic polypeptide
VGRGIAARSRTSYFDK

SEQ ID NO: 1720 - protein, 16 aa, Artificial Sequence
  Synthetic polypeptide
VARGIAARSRTSYFDY

SEQ ID NO: 1721 - protein, 16 aa, Artificial Sequence
  Synthetic polypeptide
VARGIAARSRTSYFDY

SEQ ID NO: 1722 - protein, 16 aa, Artificial Sequence
  Synthetic polypeptide
VARGIAARSRTSYFDY

SEQ ID NO: 1723 - protein, 16 aa, Artificial Sequence
  Synthetic polypeptide
VARGIVARSRTSNFDQ

SEQ ID NO: 1724 - protein, 16 aa, Artificial Sequence
  Synthetic polypeptide
LARGIAARSRTSYQDI

SEQ ID NO: 1725 - protein, 16 aa, Artificial Sequence
  Synthetic polypeptide
VARGIAARSRTSYFDY

SEQ ID NO: 1726 - protein, 109 aa, Artificial Sequence; identical to SEQ ID NO: 1118
  Synthetic polypeptide

SEQ ID NO: 1727 - protein, 142 aa, Artificial Sequence
  Synthetic polypeptide
EVQLLESGGGLVQPGGSLRLSCAASGFTFSNYLMAWVRQAPGKGLEWVSWIVPSGGYTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 1728 - protein, 109 aa, Artificial Sequence; identical to SEQ ID NO: 1118
  Synthetic polypeptide

SEQ ID NO: 1729 - protein, 142 aa, Artificial Sequence
  Synthetic polypeptide
EVQLLESGGGLVQPGGSLRLSCAASGFTFSVYMMIWVRQAPGKGLEWVSSISPSGGQTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 1730 - protein, 109 aa, Artificial Sequence; identical to SEQ ID NO: 1118
  Synthetic polypeptide

SEQ ID NO: 1731 - protein, 142 aa, Artificial Sequence
  Synthetic polypeptide
EVQLLESGGGLVQPGGSLRLSCAASGFTFSDYMMTWVRQAPGKGLQWVSYISPSGGLTSYADSVKGRFTISRDNSKNTLYLQMNSLRAEDTAVYYCARVARGIAARSRTSYFDYWGQGTLVTVSSASTKGPSVFPLAPSSKS

SEQ ID NO: 1732 - protein, 109 aa, Artificial Sequence; identical to SEQ ID NO: 1118
  Synthetic polypeptide

SEQ ID NO: 1733 - protein, 142 aa, Artificial Sequence
  Synthetic polypeptide
EVQLLESGGGLVQPGGSLRLSCAASGFTFSTYMMQWVRQAPGKGLEWVSYIGPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 1734 - protein, 109 aa, Artificial Sequence; identical to SEQ ID NO: 1118
  Synthetic polypeptide

SEQ ID NO: 1735 - protein, 142 aa, Artificial Sequence
  Synthetic polypeptide
EVQLLESGGGLVQPGGSLRLSCAASGFTFSTYLMAWVRQAPGKGLEWVSGIVSSGGRTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 1736 - protein, 109 aa, Artificial Sequence; identical to SEQ ID NO: 1118
  Synthetic polypeptide

SEQ ID NO: 1737 - protein, 142 aa, Artificial Sequence
  Synthetic polypeptide
EVQLLESGGGLVQPGGSLRLSCAASGFTFSQYDMIWVRQAPGKGLEWVSYISSSGGFTRYADSVKGRFTISRDNSKNTLYLQMNSLRAEDTAVYYCARVARGIAARSRTSYFDYWGQGTLVTVSSASTKGPSVFPLAPSSKS

SEQ ID NO: 1738 - protein, 109 aa, Artificial Sequence; identical to SEQ ID NO: 1118
  Synthetic polypeptide

SEQ ID NO: 1739 - protein, 142 aa, Artificial Sequence
  Synthetic polypeptide
EVQLLESGGGLVQPGGSLRLSCAASGFTFSNYDMIWVRQAPGKGLEWVSSISSSGGTTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1740 - protein, 109 aa, Artificial Sequence; identical to SEQ ID NO: 1118
  Synthetic polypeptide

SEQ ID NO: 1741 - protein, 142 aa, Artificial Sequence
  Synthetic polypeptide
EVQLLESGGGLVQPGGSLRLSCAASGFTFSQYMMMWVRQAPGKGLEWVSRISPSGGSTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 1742 - protein, 109 aa, Artificial Sequence; identical to SEQ ID NO: 1118
  Synthetic polypeptide

SEQ ID NO: 1743 - protein, 142 aa, Artificial Sequence
  Synthetic polypeptide
EVQLLESGGGLVQPGGSLRLSCAASGFTFSTYKMQWVRQAPGKGLEWVSSISPSGGPTNYADSVKGRFTISRDNSKNTLYLQMNSLRAEDTAVYYCARVARGIAARSRTSYFDYWGQGTLVTVSSASTKGPSVFPLAPSSKS

SEQ ID NO: 1744 - protein, 109 aa, Artificial Sequence; identical to SEQ ID NO: 1118
  Synthetic polypeptide

SEQ ID NO: 1745 - protein, 142 aa, Artificial Sequence
  Synthetic polypeptide
EVQLLESGGGLVQPGGSLRLSCAASGFTFSNYTMGWVRQAPGKGLEWVSSISPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 1746 - protein, 109 aa, Artificial Sequence; identical to SEQ ID NO: 1118
  Synthetic polypeptide

SEQ ID NO: 1747 - protein, 142 aa, Artificial Sequence
  Synthetic polypeptide
EVQLLESGGGLVQPGGSLRLSCAASGFTFSSQQMVWVRQAPGKGLEWVSYISPSGGNTYYADSVKGRFTISRDNSKNTLYLQMNSLRAEDTAVYYCARVARGIAARSRTSYFDYWGQGTLVTVSSASTKGPSVFPLAPSSKS

SEQ ID NO: 1748 - protein, 109 aa, Artificial Sequence; identical to SEQ ID NO: 1118
  Synthetic polypeptide

SEQ ID NO: 1749 - protein, 142 aa, Artificial Sequence
  Synthetic polypeptide
EVQLLESGGGLVQPGGSLRLSCAASGFTFSNYTMQWVRQAPGKGLQWVSYISPSGGYTGYADSVKGRFTISRDNSKNTLYLQMNSLRAEDTAVYYCARVARGIAARSRTSYFDYWGQGTLVTVSSASTKGPSVFPLAPSSKS

SEQ ID NO: 1750 - protein, 109 aa, Artificial Sequence; identical to SEQ ID NO: 1118
  Synthetic polypeptide

SEQ ID NO: 1751 - protein, 142 aa, Artificial Sequence
  Synthetic polypeptide
EVQLLESGGGLVQPGGSLRLSCAASGFTFSDYMMMWVRQAPGKGLEWVSSIVPSGGHTQYADSVKGRFTISRDNSKNTLYLQMNSLRAEDTAVYYCARVARGIAARSRTSYFDYWGQGTLVTVSSASTKGPSVFPLAPSSKS

SEQ ID NO: 1752 - protein, 109 aa, Artificial Sequence; identical to SEQ ID NO: 1118
  Synthetic polypeptide

SEQ ID NO: 1753 - protein, 142 aa, Artificial Sequence
  Synthetic polypeptide
EVQLLESGGGLVQPGGSLRLSCAASGFTFSNYMMGWVRQAPGKGLQWVSSISPSGGLTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1754 - protein, 109 aa, Artificial Sequence; identical to SEQ ID NO: 1118
  Synthetic polypeptide

SEQ ID NO: 1755 - protein, 142 aa, Artificial Sequence
  Synthetic polypeptide
EVQLLESGGGLVQPGGSLRLSCAASGFTFSQYLMAWVRQAPGKGLEWVSSIYPSGGWTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1756 - protein, 109 aa, Artificial Sequence; identical to SEQ ID NO: 1118
  Synthetic polypeptide

SEQ ID NO: 1757 - protein, 142 aa, Artificial Sequence
  Synthetic polypeptide
EVQLLESGGGLVQPGGSLRLSCAASGFTFSQYMMVWVRQAPGKGLEWVSSIYSSGGNTPYADSVKGRFTISRDNSKNTLYLQMNSLRAEDTAVYYCARVARGIAARSRTSYFDYWGQGTLVTVSSASTKGPSVFPLAPSSKS

SEQ ID NO: 1758 - protein, 109 aa, Artificial Sequence; identical to SEQ ID NO: 1118
  Synthetic polypeptide

SEQ ID NO: 1759 - protein, 142 aa, Artificial Sequence
  Synthetic polypeptide
EVQLLESGGGLVQPGGSLRLSCAASGFTFSEYMMMWVRQAPGKGLEWVSVISPSGGQTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 1760 - protein, 109 aa, Artificial Sequence; identical to SEQ ID NO: 1118
  Synthetic polypeptide

SEQ ID NO: 1761 - protein, 142 aa, Artificial Sequence
  Synthetic polypeptide
EVQLLESGGGLVQPGGSLRLSCAASGFTFSGYMMVWVRQAPGKGLEWVSRISPSGGPTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 1762 - protein, 109 aa, Artificial Sequence; identical to SEQ ID NO: 1118
  Synthetic polypeptide

SEQ ID NO: 1763 - protein, 142 aa, Artificial Sequence
  Synthetic polypeptide
EVQLLESGGGLVQPGGSLRLSCAASGFTFSVYMMSWVRQAPGKGLEWVSSIVPSGGSTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 1764 - protein, 109 aa, Artificial Sequence; identical to SEQ ID NO: 1118
  Synthetic polypeptide

SEQ ID NO: 1765 - protein, 142 aa, Artificial Sequence
  Synthetic polypeptide
EVQLLESGGGLVQPGGSLRLSCAASGFTFSEYMMVWVRQAPGKGLEWVSRISPSGGTTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 1766 - protein, 109 aa, Artificial Sequence; identical to SEQ ID NO: 1118
  Synthetic polypeptide

SEQ ID NO: 1767 - protein, 142 aa, Artificial Sequence
  Synthetic polypeptide
EVQLLESGGGLVQPGGSLRLSCAASGFTFSSYMMVWVRQAPGKGLEWVSSISPSGGYTIQADSVKGRFTISRDNSKNTLYLQMNSLRAEDTAVYYCARVARGIAARSRTSYFDYWGQGTLVTVSSASTKGPSVFPLAPSSKS

SEQ ID NO: 1768 - protein, 109 aa, Artificial Sequence; identical to SEQ ID NO: 1118
  Synthetic polypeptide

SEQ ID NO: 1769 - protein, 142 aa, Artificial Sequence
  Synthetic polypeptide
EVQLLESGGGLVQPGGSLRLSCAASGFTFSGYKMQWVRQAPGKGLEWVSSISPSGGITMYADSVKGRFTISRDNSKNTLYLQMNSLRAEDTAVYYCARVARGIAARSRTSYFDYWGQGTLVTVSSASTKGPSVFPLAPSSKS

SEQ ID NO: 1770 - protein, 109 aa, Artificial Sequence; identical to SEQ ID NO: 1118
  Synthetic polypeptide

SEQ ID NO: 1771 - protein, 142 aa, Artificial Sequence
  Synthetic polypeptide
EVQLLESGGGLVQPGGSLRLSCAASGFTFSDYMMAWVRQAPGKGLEWVSSIVPSGGHTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 1772 - protein, 109 aa, Artificial Sequence; identical to SEQ ID NO: 1118
  Synthetic polypeptide

SEQ ID NO: 1773 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGISARSRTSCFDYWGQGTLVTVSSASTKGPSVFPLAPSSKS

SEQ ID NO: 1774 - protein, 109 aa, Artificial Sequence; identical to SEQ ID NO: 1118
  Synthetic polypeptide

SEQ ID NO: 1775 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTALYYCARVARGIAARSRTINLDYWGQGTLVTVSSASTKGPSVFPLAPSSKS

SEQ ID NO: 1776 - protein, 109 aa, Artificial Sequence; identical to SEQ ID NO: 1118
  Synthetic polypeptide

SEQ ID NO: 1777 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRSFDYWGQGTLVTVSSASTKGPSVFPLAPSSKS

SEQ ID NO: 1778 - protein, 109 aa, Artificial Sequence; identical to SEQ ID NO: 1118
  Synthetic polypeptide

SEQ ID NO: 1779 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSYFDKWGQGTLVTVSSASTKGPSVFPLAPSSKS

SEQ ID NO: 1780 - protein, 109 aa, Artificial Sequence; identical to SEQ ID NO: 1118
  Synthetic polypeptide

SEQ ID NO: 1781 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDHWGQGTLVTVSSASTKGPSVFPLAPSSKS

SEQ ID NO: 1782 - protein, 109 aa, Artificial Sequence; identical to SEQ ID NO: 1118
  Synthetic polypeptide

SEQ ID NO: 1783 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDQWGQGTLVTVSSASTKGPSVFPLAPSSKS

SEQ ID NO: 1784 - protein, 109 aa, Artificial Sequence; identical to SEQ ID NO: 1118
  Synthetic polypeptide

SEQ ID NO: 1785 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFIDYWGQGTLVTVSSASTKGPSVFPLAPSSKS

SEQ ID NO: 1786 - protein, 109 aa, Artificial Sequence; identical to SEQ ID NO: 1118
  Synthetic polypeptide

SEQ ID NO: 1787 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARLARGIAARSRTSYQDIWGQGTLVTVSSASTKGPSVFPLAPSSKS

SEQ ID NO: 1788 - protein, 109 aa, Artificial Sequence; identical to SEQ ID NO: 1118
  Synthetic polypeptide

SEQ ID NO: 1789 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISARSRTSYFDYWGQGTLVTVSSASTKGPSVFPLAPSSKS

SEQ ID NO: 1790 - protein, 109 aa, Artificial Sequence; identical to SEQ ID NO: 1118
  Synthetic polypeptide

SEQ ID NO: 1791 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDYWGQGTLVTVSSASTKGPSVFPLAPSSKS

SEQ ID NO: 1792 - protein, 109 aa, Artificial Sequence; identical to SEQ ID NO: 1118
  Synthetic polypeptide

SEQ ID NO: 1793 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDQWGQGTLVTVSSASTKGPSVFPLAPSSKS

SEQ ID NO: 1794 - protein, 109 aa, Artificial Sequence; identical to SEQ ID NO: 1118
  Synthetic polypeptide

SEQ ID NO: 1795 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIADRSRTSYSDYWGQGTLVTVSSASTKGPSVFPLAPSSKS

SEQ ID NO: 1796 - protein, 109 aa, Artificial Sequence; identical to SEQ ID NO: 1118
  Synthetic polypeptide

SEQ ID NO: 1797 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDYWGQGTLVTVSSASTKGPSVFPLAPSSKS

SEQ ID NO: 1798 - protein, 109 aa, Artificial Sequence; identical to SEQ ID NO: 1118
  Synthetic polypeptide

SEQ ID NO: 1799 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIASRSRTRYCDYWGQGTLVTVSSASTKGPSVFPLAPSSKS

SEQ ID NO: 1800 - protein, 109 aa, Artificial Sequence; identical to SEQ ID NO: 1118
  Synthetic polypeptide

SEQ ID NO: 1801 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIVARSRTSNFDQWGQGTLVTVSSASTKGPSVFPLAPSSKS

SEQ ID NO: 1802 - protein, 109 aa, Artificial Sequence; identical to SEQ ID NO: 1118
  Synthetic polypeptide

SEQ ID NO: 1803 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIVARSRTSYLHQWGQGTLVTVSSASTKGPSVFPLAPSSKS

SEQ ID NO: 1804 - protein, 109 aa, Artificial Sequence; identical to SEQ ID NO: 1118
  Synthetic polypeptide

SEQ ID NO: 1805 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYIDQWGQGTLVTVSSASTKGPSVFPLAPSSKS

SEQ ID NO: 1806 - protein, 109 aa, Artificial Sequence; identical to SEQ ID NO: 1118
  Synthetic polypeptide

SEQ ID NO: 1807 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAYRRRTSYFDYWGQGTLVTVSSASTKGPSVFPLAPSSKS

SEQ ID NO: 1808 - protein, 109 aa, Artificial Sequence; identical to SEQ ID NO: 1118
  Synthetic polypeptide

SEQ ID NO: 1809 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCAMVGQGIRGRSRTSYFAQWGQGTLVTVSSASTKGPSVFPLAPSSKS

SEQ ID NO: 1810 - protein, 109 aa, Artificial Sequence; identical to SEQ ID NO: 1118
  Synthetic polypeptide

SEQ ID NO: 1811 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSQLDYWGQGTLVTVSSASTKGPSVFPLAPSSKS

SEQ ID NO: 1812 - protein, 109 aa, Artificial Sequence; identical to SEQ ID NO: 1118
  Synthetic polypeptide

SEQ ID NO: 1813 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGITARSRTSYFDDWGQGTLVTVSSASTKGPSVFPLAPSSKS

SEQ ID NO: 1814 - protein, 109 aa, Artificial Sequence; identical to SEQ ID NO: 1118
  Synthetic polypeptide

SEQ ID NO: 1815 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSFFDQWGQGTLVTVSSASTKGPSVFPLAPSSKS

SEQ ID NO: 1816 - protein, 109 aa, Artificial Sequence; identical to SEQ ID NO: 1118
  Synthetic polypeptide

SEQ ID NO: 1817 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCATVARGIAARSRTSYFDQWGQGTLVTVSSASTKGPSVFPLAPSSKS

SEQ ID NO: 1818 - protein, 109 aa, Artificial Sequence; identical to SEQ ID NO: 1118
  Synthetic polypeptide

SEQ ID NO: 1819 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTILLDQWGQGTLVTVSSASTKGPSVFPLAPSSKS

SEQ ID NO: 1820 - protein, 109 aa, Artificial Sequence; identical to SEQ ID NO: 1118
  Synthetic polypeptide

SEQ ID NO: 1821 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARQARGIAARSRTSYFDYWGQGTLVTVSSASTKGPSVFPLAPSSKS

SEQ ID NO: 1822 - protein, 109 aa, Artificial Sequence; identical to SEQ ID NO: 1118
  Synthetic polypeptide

SEQ ID NO: 1823 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDQWSQGTLVTVSSASTKGPSVFPLAPSSKS

SEQ ID NO: 1824 - protein, 109 aa, Artificial Sequence; identical to SEQ ID NO: 1118
  Synthetic polypeptide

SEQ ID NO: 1825 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISGRSRLSYVDYWGQGTLVTVSSASTKGPSVFPLAPSSKS

SEQ ID NO: 1826 - protein, 109 aa, Artificial Sequence; identical to SEQ ID NO: 1118
  Synthetic polypeptide

SEQ ID NO: 1827 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDTWGQGTLVTVSSASTKGPSVFPLAPSSKS

SEQ ID NO: 1828 - protein, 109 aa, Artificial Sequence; identical to SEQ ID NO: 1118
  Synthetic polypeptide

SEQ ID NO: 1829 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTTQFDYWGQGTLVTVSSASTKGPSVFPLAPSSKS

SEQ ID NO: 1830 - protein, 109 aa, Artificial Sequence; identical to SEQ ID NO: 1118
  Synthetic polypeptide

SEQ ID NO: 1831 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARQRTSYYDYWGQGTLVTVSSASTKGPSVFPLAPSSKS

SEQ ID NO: 1832 - protein, 109 aa, Artificial Sequence; identical to SEQ ID NO: 1118
  Synthetic polypeptide

SEQ ID NO: 1833 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTVYFDHWGQGTLVTVSSASTKGPSVFPLAPSSKS

SEQ ID NO: 1834 - protein, 109 aa, Artificial Sequence; identical to SEQ ID NO: 1118
  Synthetic polypeptide

SEQ ID NO: 1835 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDYWGQGTLVTVSSASTKGPSVFPLAPSSKS

SEQ ID NO: 1836 - protein, 109 aa, Artificial Sequence; identical to SEQ ID NO: 1118
  Synthetic polypeptide

SEQ ID NO: 1837 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCASVARGIAARSRTSYFNQWGQGTLVTVSSASTKGPSVFPLAPSSKS

SEQ ID NO: 1838 - protein, 109 aa, Artificial Sequence; identical to SEQ ID NO: 1118
  Synthetic polypeptide

SEQ ID NO: 1839 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTSSVDQWGQGTLVTVSSASTKGPSVFPLAPSSKS

SEQ ID NO: 1840 - protein, 109 aa, Artificial Sequence; identical to SEQ ID NO: 1118
  Synthetic polypeptide

SEQ ID NO: 1841 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVATGIVARSRTRYFDQWGQGTLVTVSSASTKGPSVFPLAPSSKS

SEQ ID NO: 1842 - protein, 109 aa, Artificial Sequence; identical to SEQ ID NO: 1118
  Synthetic polypeptide

SEQ ID NO: 1843 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDFWGQGTLVTVSSASTKGPSVFPLAPSSKS

SEQ ID NO: 1844 - protein, 109 aa, Artificial Sequence; identical to SEQ ID NO: 1118
  Synthetic polypeptide

SEQ ID NO: 1845 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRNSQQDYWGQGTLVTVSSASTKGPSVFPLAPSSKS

SEQ ID NO: 1846 - protein, 109 aa, Artificial Sequence; identical to SEQ ID NO: 1118
  Synthetic polypeptide

SEQ ID NO: 1847 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDYWGQGTLVTVSSASTKGPSVFPLAPSSKS

SEQ ID NO: 1848 - protein, 109 aa, Artificial Sequence; identical to SEQ ID NO: 1118
  Synthetic polypeptide

SEQ ID NO: 1849 - protein, 142 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDQWGQGTLVTVSSASTKGPSVFPLAPSSKS

SEQ ID NO: 1850 - protein, 60 aa, Artificial Sequence
  Synthetic polypeptide
EAMHSFCAFKADDGPCRAAHPRWFFNIFTRQCEEFSYGGCGGNQNRFESLEECKKMCTRD

SEQ ID NO: 1851 - protein, 12 aa, Artificial Sequence
  Synthetic polypeptide
RTSQFVNSNYLA

SEQ ID NO: 1852 - protein, 12 aa, Artificial Sequence
  Synthetic polypeptide
RTSQFVNSNYLA

SEQ ID NO: 1853 - protein, 12 aa, Artificial Sequence
  Synthetic polypeptide
RTSQFVNSNYLA

SEQ ID NO: 1854 - protein, 12 aa, Artificial Sequence
  Synthetic polypeptide
RTSQFVNSNYLA

SEQ ID NO: 1855 - protein, 12 aa, Artificial Sequence
  Synthetic polypeptide
RTSQFVNSNYLA

SEQ ID NO: 1856 - protein, 11 aa, Artificial Sequence
  Synthetic polypeptide
RASQSISSWLA

SEQ ID NO: 1857 - protein, 11 aa, Artificial Sequence
  Synthetic polypeptide
RASQSISSWLA

SEQ ID NO: 1858 - protein, 11 aa, Artificial Sequence
  Synthetic polypeptide
RASQSISSWLA

SEQ ID NO: 1859 - protein, 11 aa, Artificial Sequence
  Synthetic polypeptide
RASQSISSWLA

SEQ ID NO: 1860 - protein, 11 aa, Artificial Sequence
  Synthetic polypeptide
RASQSISSWLA

SEQ ID NO: 1861 - protein, 11 aa, Artificial Sequence
  Synthetic polypeptide
SGNKLGDKYVA

SEQ ID NO: 1862 - protein, 11 aa, Artificial Sequence
  Synthetic polypeptide
SGDKLGDKYTS

SEQ ID NO: 1863 - protein, 11 aa, Artificial Sequence
  Synthetic polypeptide
RASQSIRNYLN

SEQ ID NO: 1864 - protein, 11 aa, Artificial Sequence
  Synthetic polypeptide
RASQSVSSYLA

SEQ ID NO: 1865 - protein, 7 aa, Artificial Sequence
  Synthetic polypeptide
GASSRAT

SEQ ID NO: 1866 - protein, 7 aa, Artificial Sequence
  Synthetic polypeptide
GASSRAT

SEQ ID NO: 1867 - protein, 7 aa, Artificial Sequence
  Synthetic polypeptide
GASSRAT

SEQ ID NO: 1868 - protein, 7 aa, Artificial Sequence
  Synthetic polypeptide
GASSRAT

SEQ ID NO: 1869 - protein, 7 aa, Artificial Sequence
  Synthetic polypeptide
GASSRAT

SEQ ID NO: 1870 - protein, 7 aa, Artificial Sequence
  Synthetic polypeptide
KASTLES

SEQ ID NO: 1871 - protein, 7 aa, Artificial Sequence
  Synthetic polypeptide
KASTLES

SEQ ID NO: 1872 - protein, 7 aa, Artificial Sequence
  Synthetic polypeptide
KASTLES

SEQ ID NO: 1873 - protein, 7 aa, Artificial Sequence
  Synthetic polypeptide
KASTLES

SEQ ID NO: 1874 - protein, 7 aa, Artificial Sequence
  Synthetic polypeptide
KASTLES

SEQ ID NO: 1875 - protein, 7 aa, Artificial Sequence
  Synthetic polypeptide
QDTKRPS

SEQ ID NO: 1876 - protein, 7 aa, Artificial Sequence
  Synthetic polypeptide
QDTKRPS

SEQ ID NO: 1877 - protein, 7 aa, Artificial Sequence
  Synthetic polypeptide
AASTLQS

SEQ ID NO: 1878 - protein, 7 aa, Artificial Sequence
  Synthetic polypeptide
DASNRAT

SEQ ID NO: 1879 - protein, 9 aa, Artificial Sequence
  Synthetic polypeptide
QQSSRTPWT

SEQ ID NO: 1880 - protein, 9 aa, Artificial Sequence
  Synthetic polypeptide
QQSSRTPWT

SEQ ID NO: 1881 - protein, 9 aa, Artificial Sequence
  Synthetic polypeptide
QQSSRTPWT

SEQ ID NO: 1882 - protein, 9 aa, Artificial Sequence
  Synthetic polypeptide
QQSSRTPWT

SEQ ID NO: 1883 - protein, 9 aa, Artificial Sequence
  Synthetic polypeptide
QQSSRTPWT

SEQ ID NO: 1884 - protein, 8 aa, Artificial Sequence
  Synthetic polypeptide
QQYNTYWT

SEQ ID NO: 1885 - protein, 8 aa, Artificial Sequence
  Synthetic polypeptide
QQYNTYWT

SEQ ID NO: 1886 - protein, 8 aa, Artificial Sequence
  Synthetic polypeptide
QQYNTYWT

SEQ ID NO: 1887 - protein, 8 aa, Artificial Sequence
  Synthetic polypeptide
QQYNTYWT

SEQ ID NO: 1888 - protein, 8 aa, Artificial Sequence
  Synthetic polypeptide
QQYNTYWT

SEQ ID NO: 1889 - protein, 9 aa, Artificial Sequence
  Synthetic polypeptide
QAWDSSIVI

SEQ ID NO: 1890 - protein, 10 aa, Artificial Sequence
  Synthetic polypeptide
QAWDSPNARV

SEQ ID NO: 1891 - protein, 9 aa, Artificial Sequence
  Synthetic polypeptide
QQLSGYPHT

SEQ ID NO: 1892 - protein, 11 aa, Artificial Sequence
  Synthetic polypeptide
QQRSNWPRGFT

SEQ ID NO: 1893 - protein, 5 aa, Artificial Sequence
  Synthetic polypeptide
HYLMT

SEQ ID NO: 1894 - protein, 5 aa, Artificial Sequence
  Synthetic polypeptide
HYLMT

SEQ ID NO: 1895 - protein, 5 aa, Artificial Sequence
  Synthetic polypeptide
DYMMA

SEQ ID NO: 1896 - protein, 5 aa, Artificial Sequence
  Synthetic polypeptide
HYLMT

SEQ ID NO: 1897 - protein, 5 aa, Artificial Sequence
  Synthetic polypeptide
HYLMT

SEQ ID NO: 1898 - protein, 5 aa, Artificial Sequence
  Synthetic polypeptide
HYLMT

SEQ ID NO: 1899 - protein, 5 aa, Artificial Sequence
  Synthetic polypeptide
HYLMT

SEQ ID NO: 1900 - protein, 5 aa, Artificial Sequence
  Synthetic polypeptide
IYSMH

SEQ ID NO: 1901 - protein, 5 aa, Artificial Sequence
  Synthetic polypeptide
HYLMT

SEQ ID NO: 1902 - protein, 5 aa, Artificial Sequence
  Synthetic polypeptide
HYLMT

SEQ ID NO: 1903 - protein, 5 aa, Artificial Sequence
  Synthetic polypeptide
WYTMV

SEQ ID NO: 1904 - protein, 5 aa, Artificial Sequence
  Synthetic polypeptide
HYLMT

SEQ ID NO: 1905 - protein, 5 aa, Artificial Sequence
  Synthetic polypeptide
FYYMV

SEQ ID NO: 1906 - protein, 5 aa, Artificial Sequence
  Synthetic polypeptide
YYHMS

SEQ ID NO: 1907 - protein, 17 aa, Artificial Sequence
  Synthetic polypeptide
YISPSGGHTIYADSVKG

SEQ ID NO: 1908 - protein, 17 aa, Artificial Sequence
  Synthetic polypeptide
YISPSGGHTIYADSVKG

SEQ ID NO: 1909 - protein, 17 aa, Artificial Sequence
  Synthetic polypeptide
SIVPSGGHTHYADSVKG

SEQ ID NO: 1910 - protein, 17 aa, Artificial Sequence
  Synthetic polypeptide
YISPSGGHTIYADSVKG

SEQ ID NO: 1911 - protein, 17 aa, Artificial Sequence
  Synthetic polypeptide
YISPSGGHTIYADSVKG

SEQ ID NO: 1912 - protein, 17 aa, Artificial Sequence
  Synthetic polypeptide
GIYSSGGITVYADSVKG

SEQ ID NO: 1913 - protein, 17 aa, Artificial Sequence
  Synthetic polypeptide
GIYSSGGITVYADSVKG

SEQ ID NO: 1914 - protein, 17 aa, Artificial Sequence
  Synthetic polypeptide
SIYPSRGMTWYADSVKG

SEQ ID NO: 1915 - protein, 17 aa, Artificial Sequence
  Synthetic polypeptide
GIYSSGGITVYADSVKG

SEQ ID NO: 1916 - protein, 17 aa, Artificial Sequence
  Synthetic polypeptide
GIYSSGGITVYADSVKG

SEQ ID NO: 1917 - protein, 17 aa, Artificial Sequence
  Synthetic polypeptide
YIYPSGGATFYADSVKG

SEQ ID NO: 1918 - protein, 17 aa, Artificial Sequence
  Synthetic polypeptide
SIYPSGGRTVYADSVKG

SEQ ID NO: 1919 - protein, 17 aa, Artificial Sequence
  Synthetic polypeptide
VIYPSGGITVYADSVKG

SEQ ID NO: 1920 - protein, 17 aa, Artificial Sequence
  Synthetic polypeptide
VISPSGGSTKYADSVKG

SEQ ID NO: 1921 - protein, 16 aa, Artificial Sequence
  Synthetic polypeptide
VARGIAARSRTSYFDY

SEQ ID NO: 1922 - protein, 16 aa, Artificial Sequence
  Synthetic polypeptide
VGQGIRGRSRTSYFAQ

SEQ ID NO: 1923 - protein, 16 aa, Artificial Sequence
  Synthetic polypeptide
VARGIAARSRTSYFDY

SEQ ID NO: 1924 - protein, 16 aa, Artificial Sequence
  Synthetic polypeptide
VAQGIAARSRTSSVDQ

SEQ ID NO: 1925 - protein, 16 aa, Artificial Sequence
  Synthetic polypeptide
VAQGISARSRTSYFDY

SEQ ID NO: 1926 - protein, 13 aa, Artificial Sequence
  Synthetic polypeptide
RRTGIPRRDAFDI

SEQ ID NO: 1927 - protein, 13 aa, Artificial Sequence
  Synthetic polypeptide
RRIGVPRRDSFDM

SEQ ID NO: 1928 - protein, 13 aa, Artificial Sequence
  Synthetic polypeptide
RRTGIPRRDAFDI

SEQ ID NO: 1929 - protein, 13 aa, Artificial Sequence
  Synthetic polypeptide
RRIGVPRRDEFDI

SEQ ID NO: 1930 - protein, 13 aa, Artificial Sequence
  Synthetic polypeptide
RRTGVPRRDEFDI

SEQ ID NO: 1931 - protein, 13 aa, Artificial Sequence
  Synthetic polypeptide
GSYDYIWGFYSDH

SEQ ID NO: 1932 - protein, 19 aa, Artificial Sequence
  Synthetic polypeptide
DKFEWRLLFRGIGNDAFDI

SEQ ID NO: 1933 - protein, 16 aa, Artificial Sequence
  Synthetic polypeptide
DKWAVMPPYYYYAMDV

SEQ ID NO: 1934 - protein, 19 aa, Artificial Sequence
  Synthetic polypeptide
GGSSDYAWGSYRRPYYFDY

SEQ ID NO: 1935 - protein, 106 aa, Artificial Sequence; identical to SEQ ID NO: 242
  Synthetic polypeptide

SEQ ID NO: 1936 - protein, 107 aa, Artificial Sequence; identical to SEQ ID NO: 250
  Synthetic polypeptide

SEQ ID NO: 1937 - protein, 106 aa, Artificial Sequence
  Synthetic polypeptide
DIQMTQSPSTLSASVGDRVTITCRASQSISSWLAWYQQKPGKAPNLLIYKASTLESGVPSRFSGSGSGTEFTLTISSLQPDDFATYYCQQYNTYWTFGQGTKVEIK

SEQ ID NO: 1938 - protein, 108 aa, Artificial Sequence
  Synthetic polypeptide
EIVLTQSPGTLSLSPGERATLSCRTSQFVNSNYLAWYQQKPGQAPRLLIYGASSRATGIPDRFSGSGSGTDFTLTISRLEPEDFAVYYCQQSSRTPWTFGQGTKVEIK

SEQ ID NO: 1939 - protein, 106 aa, Artificial Sequence
  Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIK

SEQ ID NO: 1940 - protein, 108 aa, Artificial Sequence; identical to SEQ ID NO: 1938
  Synthetic polypeptide

SEQ ID NO: 1941 - protein, 106 aa, Artificial Sequence; identical to SEQ ID NO: 1939
  Synthetic polypeptide

SEQ ID NO: 1942 - protein, 108 aa, Artificial Sequence; identical to SEQ ID NO: 1938
  Synthetic polypeptide

SEQ ID NO: 1943 - protein, 108 aa, Artificial Sequence; identical to SEQ ID NO: 1938
  Synthetic polypeptide

SEQ ID NO: 1944 - protein, 106 aa, Artificial Sequence; identical to SEQ ID NO: 1939
  Synthetic polypeptide

SEQ ID NO: 1945 - protein, 106 aa, Artificial Sequence; identical to SEQ ID NO: 1939
  Synthetic polypeptide

SEQ ID NO: 1946 - protein, 108 aa, Artificial Sequence; identical to SEQ ID NO: 1938
  Synthetic polypeptide

SEQ ID NO: 1947 - protein, 107 aa, Artificial Sequence
  Synthetic polypeptide
DIQMTQSPSSLSASVGDRVTITCRASQSIRNYLNWYQQKPGKAPNLLIYAASTLQSGVPARFSGSGSGTDFTLTISSLQPEDFATYYCQQLSGYPHTFGQGTKLEIK

SEQ ID NO: 1948 - protein, 110 aa, Artificial Sequence; identical to SEQ ID NO: 246
  Synthetic polypeptide

SEQ ID NO: 1949 - protein, 122 aa, Artificial Sequence
  Synthetic polypeptide
EVQLLESGGGLVQPGGSLRLSCAASGFTFSWYTMVWVRQAPGKGLEWVSYIYPSGGATFYADSVKGRFTISRDNSKNTLYLQMNSLRAEDTAVYYCAMGSYDYIWGFYSDHWGQGTLVTVSS

SEQ ID NO: 1950 - protein, 128 aa, Artificial Sequence
  Synthetic polypeptide
EVQLLESGGGLVQPGGSLRLSCAASGFTFSHYRMSWVRQAPGKGLEWVSSIYPSGGRTVYADSVKGRFTISRDNSKNTLYLQMNSLRAEDTAVYYCAKDKFEWRLLFRGIGNDAFDIWGQGTMVTVSS

SEQ ID NO: 1951 - protein, 122 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDIWGQGTMVTVSS

SEQ ID NO: 1952 - protein, 125 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSS

SEQ ID NO: 1953 - protein, 122 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAWRRIGVPRRDSFDMWGQGTMVTVSS

SEQ ID NO: 1954 - protein, 125 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCAMVGQGIRGRSRTSYFAQWGQGTLVTVSS

SEQ ID NO: 1955 - protein, 122 aa, Artificial Sequence
  Synthetic polypeptide
EVQLLESGGGLVQPGGSLRLSCAASGFTFSIYSMHWVRQAPGKGLEWVSSIYPSRGMTWYADSVKGRFTISRDNSKNTLYLQMNSLRAEDTAVYYCAYRRTGIPRRDAFDIWGQGTMVTVSS

SEQ ID NO: 1956 - protein, 125 aa, Artificial Sequence
  Synthetic polypeptide
EVQLLESGGGLVQPGGSLRLSCAASGFTFSDYMMAWVRQAPGKGLEWVSSIVPSGGHTHYADSVKGRFTISRDNSKNTLYLQMNSLRAEDTAVYYCARVARGIAARSRTSYFDYWGQGTLVTVSS

SEQ ID NO: 1957 - protein, 125 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTSSVDQWGQGTLVTVSS

SEQ ID NO: 1958 - protein, 122 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSS

SEQ ID NO: 1959 - protein, 122 aa, Artificial Sequence
  Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDEFDIWGQGTMVTVSS

SEQ ID NO: 1960 - protein, 125 aa, Artificial Sequence
  Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISARSRTSYFDYWGQGTLVTVSS

SEQ ID NO: 1961 - protein, 125 aa, Artificial Sequence
  Synthetic polypeptide
EVQLLESGGGLVQPGGSLRLSCAASGFTFSFYYMVWVRQAPGKGLEWVSVIYPSGGITVYADSVKGRFTISRDNSKNTLYLQMNSLRAEDTAVYYCARDKWAVMPPYYYYAMDVWGQGTTVTVSS

SEQ ID NO: 1962 - protein, 128 aa, Artificial Sequence
  Synthetic polypeptide
EVQLLESGGGLVQPGGSLRLSCAASGFTFSYYHMSWVRQAPGKGLEWVSVISPSGGSTKYADSVKGRFTISRDNSKNTLYLQMNSLRAEDTAVYYCARGGSSDYAWGSYRRPYYFDYWGQGTLVTVSS

SEQ ID NO: 1963 - DNA, 318 bp, Artificial Sequence
  Synthetic polynucleotide
cagagcgctttgactcagccacccacagtgtctgtgtccccaggacagacagccaggatcacctgctctggaaataaattgggggataaatatgttgcctggtatcagcagaagccaggccagtcccctatgttggtcatctatcaagatactaagcgcccctcaagagtttctgagcgattctctggctccaactctgcgaatacagccactctgtccatcagcgggacccaggctctggatgaggctgactattactgtcaggcgtgggacagcagcattgtgatcttcggcggagggaccaggctgaccgtccta

SEQ ID NO: 1964 - DNA, 321 bp, Artificial Sequence
  Synthetic polynucleotide
cagagcgtcttgactcagccaccctcagtgtccgtgtctccaggacagacagccagcatcacctgctctggagataaattgggggataaatatacttcctggtatcagcagaggccaggccagtcccctgtattggtcatctatcaagatatcaagcggccctcagggatccctgagcgattctctggctccaactctgggaacacagccactctgaccatcagcgggacccaggctatggatgaggctgactattactgtcaggcgtgggacagtcccaatgcgagggtcttcggatctgggaccaaggtcaccgtccta

SEQ ID NO: 1965 - DNA, 318 bp, Artificial Sequence
  Synthetic polynucleotide
gacatccagatgacccagtctccttccaccctgtctgcatctgtaggagacagagtcaccatcacttgccgggccagtcagagtatcagtagttggttggcctggtatcagcagaaaccagggaaagcccctaacctcctgatctataaggcgtctactttagaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaa

SEQ ID NO: 1966 - DNA, 324 bp, Artificial Sequence
  Synthetic polynucleotide
gagatcgtgctgacccagtcccctggcaccctgtctctgtctcccggcgagagagccaccctgtcctgccggacctcccagttcgtgaactccaactacctggcttggtatcagcagaagccaggccaggcccctagactgctgatctacggcgcctcttccagagccaccggcatccctgaccggttctccggctctggctccggcaccgacttcaccctgaccatctcccggctggaacctgaggacttcgccgtgtactactgccagcagtcctcccggaccccttggacctttggccagggcaccaaggtggagatcaag

SEQ ID NO: 1967 - DNA, 318 bp, Artificial Sequence
  Synthetic polynucleotide
gacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaag

SEQ ID NO: 1968 - DNA, 324 bp, Artificial Sequence; identical to SEQ ID NO: 1966
  Synthetic polynucleotide

SEQ ID NO: 1969 - DNA, 318 bp, Artificial Sequence; identical to SEQ ID NO: 1967
  Synthetic polynucleotide

SEQ ID NO: 1970 - DNA, 324 bp, Artificial Sequence; identical to SEQ ID NO: 1966
  Synthetic polynucleotide

SEQ ID NO: 1971 - DNA, 324 bp, Artificial Sequence; identical to SEQ ID NO: 1966
  Synthetic polynucleotide

SEQ ID NO: 1972 - DNA, 318 bp, Artificial Sequence; identical to SEQ ID NO: 1967
  Synthetic polynucleotide

SEQ ID NO: 1973 - DNA, 318 bp, Artificial Sequence; identical to SEQ ID NO: 1967
  Synthetic polynucleotide

SEQ ID NO: 1974 - DNA, 324 bp, Artificial Sequence; identical to SEQ ID NO: 1966
  Synthetic polynucleotide

SEQ ID NO: 1975 - DNA, 321 bp, Artificial Sequence
  Synthetic polynucleotide
gacatccagatgacccagtctccatcctccctgtctgcatctgtaggagacagagtcaccatcacttgccgggcaagtcagagtattcgcaactatttaaattggtatcagcagaaaccagggaaagcccctaacctcctgatctatgctgcatccactttgcaaagtggggtcccagcaaggttcagtggcagtggatctgggacagatttcactctcactatcagcagtctgcagcctgaagattttgcaacttattactgtcaacagcttagtggttacccccacacttttggccaggggaccaagctggagatcaaa

SEQ ID NO: 1976 - DNA, 330 bp, Artificial Sequence
  Synthetic polynucleotide
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcgcggattcactttcggccctgggaccaaagtggatatcaaa

SEQ ID NO: 1977 - DNA, 366 bp, Artificial Sequence
  Synthetic polynucleotide
gaagttcaattgttagagtctggtggcggtcttgttcagcctggtggttctttacgtctttcttgcgctgcttccggattcactttctcttggtacactatggtttgggttcgccaagctcctggtaaaggtttggagtgggtttcttatatctatccttctggtggcgctactttttatgctgactccgttaaaggtcgcttcactatctctagagacaactctaagaatactctctacttgcagatgaacagcttaagggctgaggacacggccgtgtattactgtgcgatgggttcatatgattacatttggggattttatagtgaccactggggccagggaaccctggtcaccgtctcaagc

SEQ ID NO: 1978 - DNA, 384 bp, Artificial Sequence
  Synthetic polynucleotide
gaagttcaattgttagagtctggtggcggtcttgttcagcctggtggttctttacgtctttcttgcgctgcttccggattcactttctctcattaccgtatgtcttgggttcgccaagctcctggtaaaggtttggagtgggtttcttctatctatccttctggtggccgtactgtttatgctgactccgttaaaggtcgcttcactatctctagagacaactctaagaatactctctacttgcagatgaacagcttaagggctgaggacacggccgtgtattactgtgcgaaagataagttcgagtggaggttattatttcgcgggattggaaatgatgcttttgatatctggggccaagggacaatggtcaccgtctcaagc

SEQ ID NO: 1979 - DNA, 366 bp, Artificial Sequence
  Synthetic polynucleotide
gaagttcaattgttagagtctggtggcggtcttgttcagcctggtggttctttacgtctttcttgcgctgcttccggattcactttctctcattacattatgatgtgggttcgccaagctcctggtaaaggtttggagtgggtttctggtatctattcttctggtggcattactgtttatgctgactccgttaaaggtcgcttcactatctctagagacaactctaagaatactctctacttgcagatgaacagcttaagggctgaggacacggccgtgtattactgtgcgtaccgccggactgggattccaagaagagatgcttttgatatctggggccaagggacaatggtcaccgtctcaagc

SEQ ID NO: 1980 - DNA, 375 bp, Artificial Sequence
  Synthetic polynucleotide
gaggtgcaattgctggaatccggcggaggtctggtgcagcctggcggctccctgagactgtcttgcgccgcctccggcttcaccttctcccactacctgatgacctgggtgcgccaggctcctggcaagggcctcgaatgggtgtcctacatctccccctctggcggccacaccatctacgccgactccgtgaagggccggttcaccatctcccgggacaactccaagaacaccctgtatctgcagatgaactccctgagggccgaggacaccgccgtgtactactgcgccagggtggccagaggaatcgccgccaggtcccggacctcctacttcgactactggggccagggcaccctggtgaccgtgtcctcc

SEQ ID NO: 1981 - DNA, 366 bp, Artificial Sequence
  Synthetic polynucleotide
gaggtgcaattgctggaatccggcggaggactggtgcagcctggcggctccctgagactgtcttgcgccgcctccggctttaccttctcccactacatcatgatgtgggtgcgacaggctccaggcaagggcctggaatgggtgtccggcatctactcctccggcggcatcaccgtgtacgccgactccgtgaagggccggttcaccatctcccgggacaactccaagaacaccctgtacctgcagatgaactccctgcgggccgaggacaccgccgtgtactactgtgcctggcggagaatcggcgtgcccagacgggactccttcgacatgtggggacagggcaccatggtgacagtgtcctcc

SEQ ID NO: 1982 - DNA, 375 bp, Artificial Sequence
  Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgccatggtcggccagggaatccggggcagatcccggacctcctacttcgcccagtggggccagggcaccctggtgacagtgtcctct

SEQ ID NO: 1983 - DNA, 366 bp, Artificial Sequence
  Synthetic polynucleotide
gaggtgcaattgctggaatccggcggaggactggtgcagcctggcggctccctgagactgtcttgcgccgcctccggcttcaccttctccatctactccatgcactgggtgcgacaggctccaggcaagggcctggaatgggtgtcctccatctacccctcccggggcatgacttggtacgccgactccgtgaagggccggttcacaatctcccgggacaactccaagaacaccctgtacctgcagatgaactccctgcgggccgaggacaccgccgtgtactactgcgcctaccggcggaccggcatccctagacgggacgccttcgacatctgggggcagggcaccatggtgacagtgtcctcc

SEQ ID NO: 1984 - DNA, 375 bp, Artificial Sequence
  Synthetic polynucleotide
gaggtgcaattgctggaatccggcggtggactggtgcagcctggcggctccctgagactgtcttgcgccgcctccggcttcaccttctccgactacatgatggcctgggtgcgacaggcccctggcaagggactggaatgggtgtcctccatcgtgccctctggcggccacacccactacgccgactccgtgaagggccggttcaccatctcccgggacaactccaagaacaccctgtacctgcagatgaactccctgcgggccgaggacaccgccgtgtactactgcgccagagtggccagaggaatcgccgccagatcccggacctcctacttcgactactggggccagggcaccctggtgacagtgtcctcc

SEQ ID NO: 1985 - DNA, 375 bp, Artificial Sequence
  Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgcccgggtggcccagggaatcgccgccagatcccggacctcctctgtggatcagtggggccagggcaccctggtgacagtgtcctct

SEQ ID NO: 1986 - DNA, 366 bp, Artificial Sequence
  Synthetic polynucleotide
gaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctcc

SEQ ID NO: 1987 - DNA, 366 bp, Artificial Sequence
  Synthetic polynucleotide
gaggtgcaattgctggaatccggcggaggactggtgcagcctggcggctccctgagactgtcttgcgccgcctccggcttcaccttctctcactacattatgatgtgggtgcgacaggctcctggcaaaggcctggaatgggtgtccggcatctactcctccggcggcatcaccgtgtacgccgactccgtgaagggccggttcaccatctcccgggacaactccaagaacaccctgtacctgcagatgaactccctgcgggccgaggacaccgccgtgtactactgcgcctacagacggaccggcgtgcccagacgggacgagttcgatatctgggggcagggcaccatggtgacagtgtcctcc

SEQ ID NO: 1988 - DNA, 375 bp, Artificial Sequence
  Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgcccgggtggcccagggaatctccgccagatcccggacctcctacttcgattactggggccagggcaccctggtgacagtgtcctct

SEQ ID NO: 1989 - DNA, 375 bp, Artificial Sequence
  Synthetic polynucleotide
gaagttcaattgttagagtctggtggcggtcttgttcagcctggtggttctttacgtctttcttgcgctgcttccggattcactttctctttttactatatggtttgggttcgccaagctcctggtaaaggtttggagtgggtttctgttatctatccttctggtggcattactgtttatgctgactccgttaaaggtcgcttcactatctctagagacaactctaagaatactctctacttgcagatgaacagcttaagggctgaggacacggccgtgtattactgtgcgagagataaatgggcggtgatgcccccctactactactacgctatggacgtctggggccaagggaccacggtcaccgtctcaagc

SEQ ID NO: 1990 - DNA, 384 bp, Artificial Sequence
  Synthetic polynucleotide
gaagttcaattgttagagtctggtggcggtcttgttcagcctggtggttctttacgtctttcttgcgctgcttccggattcactttctcttattaccatatgtcttgggttcgccaagctcctggtaaaggtttggagtgggtttctgttatctctccttctggtggctctactaagtatgctgactccgttaaaggtcgcttcactatctctagagacaactctaagaatactctctacttgcagatgaacagcttaagggctgaggacactgcagtctactattgtgcgagaggcggttcgagcgattacgcttgggggagttatcgtcgaccctactactttgactactggggccagggaaccctggtcaccgtctcaagc

SEQ ID NO: 1991 - DNA, 327 bp, Artificial Sequence
  Synthetic polynucleotide
caagacatccagatgacccagtctccaggcaccctgtctttgtctccaggggaaagagccaccctctcctgcaggaccagtcaatttgttaacagcaactacttagcctggtaccaacagacacctggccaggctcccaggctcctcatctatggtgcatccagcagggccactggcatcccagacaggttcagtggcactgggtatgggacagacttcactctcaccatcagcagactggagcctgaagattatggaacttactactgtcagcagagttccagaaccccgtggacgttcggccaagggaccagagtggaaatcaaa

SEQ ID NO: 1992 - DNA, 324 bp, Artificial Sequence; identical to SEQ ID NO: 1966
  Synthetic polynucleotide

SEQ ID NO: 1993 - protein, 109 aa, Artificial Sequence; identical to SEQ ID NO: 1118
  Synthetic polypeptide

SEQ ID NO: 1994 - protein, 108 aa, Artificial Sequence; identical to SEQ ID NO: 1938
  Synthetic polypeptide

SEQ ID NO: 1995 - DNA, 375 bp, Artificial Sequence; identical to SEQ ID NO: 1980
  Synthetic polynucleotide

SEQ ID NO: 1996 - DNA, 375 bp, Artificial Sequence
  Synthetic polynucleotide
gaagttcaattgttagagtctggtggcggtcttgttcagcctggtggttctttacgtctttcttgcgctgcttccggattcactttctctcattaccttatgacttgggttcgccaagctcctggtaaaggtttggagtgggtttcttatatctctccttctggtggccatactatttatgctgactccgttaaaggtcgcttcactatctctagagacaactctaagaatactctctacttgcagatgaacagcttaagggctgaggacacggccgtgtattactgtgcgagagtggcccgggggatagcagctcgatcgcgaaccagctactttgactactggggccagggaaccctggtcaccgtctcaagc

SEQ ID NO: 1997 - protein, 125 aa, Artificial Sequence; identical to SEQ ID NO: 1952
  Synthetic polypeptide

SEQ ID NO: 1998 - protein, 125 aa, Artificial Sequence; identical to SEQ ID NO: 1952
  Synthetic polypeptide

SEQ ID NO: 1999 - protein, 638 aa, Artificial Sequence [sequence omitted]

SEQ ID NO: 2000 - protein, 636 aa, Artificial Sequence
  Synthetic polypeptide
MIALRQAAYFICLFATVSCGCLTQLYHNIFFRGGDVSAMYTPDAQYCQLMCTFHPRCLLFSFLPENSTSDADKRFGCFLKCSVTGTLPRVSRTGAISGHSLKRCGHQISACHRSIYKGIDMRGVNFNASKVRSAKECQERCTNNIHCQFFTYAYKTFFSAEYRNTCLLKRSPQGTPTRIKVLSDVESGFSLKACGNSKIGCRVDIFQHSAFSDVDVAGIIAPDAFVCRTICTYHPSCLFFTFYTNAWKTDSQRNVCFLKTSQSGSPSSPTPQENAISGYSLLTCKQTLPGTEPCHSKIYPQVAFEGEELHVTFVKGVDGCQETCTKMIRCQFFTYSLFPEDCRGEKCKCSLRLSLDGSPTNITYGTQASSGYSLRLCKRGDSRVCTTKRTRIVGGTNASWGESPWQVSLQVKQRAQSHLCGGSIIGRQWVLTAAHCFDGLLLSNIWRIYGGILNLSEITTETSFSQIKEIIVHPNYKISEGSHDIALIKLEAPLNFTDLQKAICLPSKDDTKPVYTDCWITGWGFTEEKGKIQNTLQKANIPLISNEECQKSYRDYKITKQMICAGYKEGGKDACKGDSGGPLVCQHEETWHLVGITSWGEGCARREQPGVYTKVAEYVDWILEKTQDSHGQPLRK

SEQ ID NO: 2001 - protein, 638 aa, Artificial Sequence
  Synthetic polypeptide
MILFNRVGYFVSLFATVSCGCMTQLYKNTFFRGGDLAAIYTPDAQYCQKMCTFHPRCLLFSFLAVTPPKETNKRFGCFMKESITGTLPRIHRYGAISGHSLKQCGHQISACHRDITKGLDMRGSNFNISKTDNIEECQKLCTNNFHCQFFTYATSAFYRPEYRKKCLLKHSASGTPTSIKSADNLVSGFSLKSCALSEIGCPMDIFQHSAFADLNVSQVITPDAFVCRTICTFHPNCLFFTFYTNEWETESQRNVCFLKTSKSGRPSPPEPQENAISGYSLLTCRKTRPEPCHSKIYSGVDFEGEELNVTFVQGADVCQETCTKTIFCQFFITSLLPQDCKEEGCKCSLRLSTDGSPTRITYGMQGSSGYSLRLCKLVDSPDCTTKINARIVGGTNASLGEWPWQVSLQVKLVSQTHLCGGSIIGRQWVLTAAHCFDGIPYPDVWRIYGGILSLSEITKETPSSRIKELIIHQEYKVSEGNYDIALIKLQTPLNYTEFQKPICLPSKADTNTIYTNCWVTGWGYTKEQGETQNILQKATIPLVPNEECQKKYRDYVINKQMICAGYKEGGTDACKGDSGGPLVCKHSGRWQLVGITSWGEGCGRKDQPGVYTKVSEYMDWILEKTQSSDVRALETSSA

SEQ ID NO: 2002 - protein, 638 aa, Artificial Sequence
  Synthetic polypeptide
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSQVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 2003 - protein, 643 aa, Artificial Sequence
  Synthetic polypeptide
MEVIVLFRIISFRQAVYFMCLFAAVSCGCLPQLHKNTFFRGGDVSAMYTPSARHCQMMCTFHPRCLLFSFLPADSTSVTDKRFGCFLKDSVTGMLPRVLRENAISGHSLKQCGHQIRACHRDIYKGIDMRGVNFNVSKVKTVEECQERCTNSIHCLFFTYATQAFNNAEYRNNCLLKHSPGGTPTSIKVLANVESGFSLKPCADSEIGCHMDIFQHLAFSDVDVARVIAPDAFVCRTICTYHPNCLFFTFYTNAWKIESQRNVCFLKTSHSGTPSFPTPQENAISGYSLLTCKQTLPEPCHSKIYSEVDFEGEELNVTFVQGANLCQETCTKTIRCQFFTYSLHPEDCRGEKCKCSLRLSSDGSPTKITHGMRASSGYSLRLCRSGDHSACATKANTRIVGGTDSFLGEWPWQVSLQAKLRAQNHLCGGSIIGHQWVLTAAHCFDCLSLPDIWRIYGGILNISEITKETPFSQVKEIIIHQNYKILESGHDIALLKLETPLNYTDFQKPICLPSRDDTNVVYTNCWVTGWGFTEEKGEIQNILQKVNIPLVSNEECQKSYRDHKISKQMICAGYKEGGKDACKGESGGPLVCKYNGIWHLVGTTSWGEGCARREQPGVYTKVIEYMDWILEKTQDDDGQSWMK

SEQ ID NO: 2004 - protein, 629 aa, Artificial Sequence
  Synthetic polypeptide
MACYYSSLLFLLLFTLVSGGCISELYQDIYWQGGDLRSVFAPDVEYCQLVCTFSPRCLMFSYLPASWPKENERFACYLKESATNMLPKVTLTGVISGHSLKNCKSKINVCRDKNFPGIDMIGTNYNVTSTANVQQCKEGCTNDIYCQYFTYVTQEFHSAQLRNRCYFKYSGKGMPTRIRLLDNVISGFSLKACGKSSLGCQNDLFQNMELPGETLTRVFAPDVLTCQKICTFYPNCLFFTFFKKDSKDPLQRNVCYVRTSTKGIPDEVINKEHTISGFSLLSCKFSPSVCPLTMLSDSEFLGDELLVEEVSGEKECQQACTNNIRCQFFTYGPVKSGCLEKKCKCHMKISSNGLPTGIRHGNGGISGFSLRLCKMKSVKGCGEPSEHANRIVGGTDSVLGEWPWQVSMHLRLGASYKKHACGGSIISNQWIVTAAHCVALYPQPQMWIIYSGFVRILNITKSTPFSELEKIIIHPHYTGAGNGSDIALLKLKTPIVFNDHQKAICLPPSEATLVLPNSCWITGWGYTEETGSPGNVLQKAEVPPISTEECQGSYVETRIDKKVLCAGYKSGKIDACKGDSGGPLVCEVDEIWYLTGITSWGEGCARPGKPGVYTRVSTFTNWILEHTKL

SEQ ID NO: 2005 - protein, 641 aa, Artificial Sequence
  Synthetic polypeptide
MILFKQATYFISLFATVSCGCLTQLYENAFFRGGDVASMYTPNAQHCQMMCTFHPRCLLFSFLPASSINDMEKRFGCFLKDSVTGTLPKVRRAGAISGHSLKQCGHQISACHRDIYKGIDMRGVNFNVSKVSSVEECQKRCTNNIRCQFFSYATQTFHNAEYRNTCLLKHSPGGTPTTIKVLNNVESGFSLKPCALSEIGCHMNIFQHLAFSDVDVARVLAPDAFVCRTICTYHPSCLFFTFYTNAWKIESQRRVCMLAGSQDGAAHSSLGDARLRLKQKNKNKQTKKNTLPEPCHSKIYPGVDFGGEELNVTFVKGVNVCQETCTKMIRCQFFTYSLLPEDCKEEKCKCFLRLSSDGSPTRITYGTQGSSGYSLRLCNTGDSSVCTTKTSSRIVGGTNSSWGEWPWQVSLQVKLMAQRHLCGGSLIGHQWVLTAAHCFDGLPLPDVWRIYSGILNLSDITKETPFSQIKEIIIHQNYRISEGNHDIALIKLQAPLNYTEFQKPICLPSKGDTNTIYTNCWVTGWGFSKEKGEIQDILQKVNIPLVTNEECQKRYQDYKITQRMVCAGYKEGGKDACKGDSGGPLACKHNGMWRLVGITSWGEGCARREQPGVYTKVAEYMDWILEKTQSSDGNARMQAPA

SEQ ID NO: 2006 - protein, 629 aa, Artificial Sequence
  Synthetic polypeptide
MLIKLPLKWVSQGCLTQLYKNTFFKGGDLTAMYTPNAHHCQMMCTFHPRCLLFSFLPESSTNDVNKRFGCFLKDSVTETLPRMSWTSAISGHSLKQCGHQISACHRDIHKGIDMRGVNFNVSKVKSVEECQKKCTNSIHCQFFTYATETFYNVEYRNSCLLKNGPGGTPSSIKVLADVVSGFSLKSCALSEIGCHMNIFQHLAFSDVDVARVVTPDAFVCQTICTYHPNCLFFTFYTKAWHLEPQRNVCFLKTSKSGTPSSPTSQKNAMSGYSLLTCKKALPEPCHSKIYSGVDFEGEELNVTFAEGVNACQETCTKMIRCQFFTYSLRPEDCRGEKCKCSLRLSLDGSPTGMTYGTRVSSGYSLRLCKSGDSSVCTTKTSTRIVGGTNSSWGEWPWQVSLQVKLRAQSHLCGGSIIGRQWVLTAAHCFDELSLPDVWRIYSGILNLSEITKETPFSQIKEIIIHQNYKITDGGSYDIALIKLEAPLNYTEFQKPICLPSKDDTNTTYTNCWVTGWGFTKERGEIQNSLQKANIPLVPNEECQKKYRDYEVNKQMICAGYKEGGKDACKGDSGGPLVCKHNGNWHLVGITSWGEGCGRREQPCVYTKVAEYVDWILEKTQVGDGHAGLG

We claim:

1. An isolated monoclonal antibody that binds to the active form of human plasma kallikrein and does not bind human prekallikrein.

2. The isolated monoclonal antibody of claim 1, wherein the antibody binds and inhibits the active form of human plasma kallikrein.

3. The isolated monoclonal antibody of claim 1, wherein the antibody has an on rate of greater than $10^5$ or $10^6$.

4. An isolated monoclonal antibody that binds the same epitope in plasma kallikrein as or competes for binding to plasma kallikrein with an antibody comprising the same heavy chain and light chain variable regions of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-G04, M29-D09, M145-D11, M06-D09 and M35-G04.

5. The isolated monoclonal antibody of claim 4, wherein the antibody competes with or binds the same epitope in plasma kallikrein as an antibody comprising the same heavy chain and light chain variable regions as X81-B01.

6. The isolated monoclonal antibody claim 4, wherein the antibody competes with or binds the same epitope in plasma kallikrein as an antibody comprising the same heavy chain and light chain variable regions as X67-D03.

7. The isolated monoclonal antibody of claim 4, wherein the antibody competes with or binds the same epitope in plasma kallikrein as an antibody comprising the same heavy chain and light chain variable regions as X101-A01.

8. The isolated monoclonal antibody of claim 4, wherein the antibody competes with or binds the same epitope in plasma kallikrein as A04 an antibody comprising the same heavy chain and light chain variable regions as M162-A04.

9. The isolated monoclonal antibody of claim 4, wherein the antibody competes with or binds the same epitope in plasma kallikrein as an antibody comprising the same heavy chain and light chain variable regions as X63-G06.

10. The isolated monoclonal antibody of claim 4, wherein the antibody binds human plasma kallikrein and murine plasma kallikrein but does not bind human prekallikrein.

11. The isolated monoclonal antibody of claim 10, wherein the antibody does not bind murine prekallikrein.

12. The isolated monoclonal antibody of claim 1, wherein the antibody binds one or more of amino acids of: Arg551, Gln553, Tyr555, Thr558, and Arg560 of human plasma kallikrein.

13. The isolated monoclonal antibody of claim 1, wherein the antibody binds one or more of amino acids of: 5478, N481, 5525, and K526 of human plasma kallikrein.

14. The isolated monoclonal antibody of claim 1, wherein the antibody binds one or more amino acids of: Ser479, Tyr563, and Asp585 of human plasma kallikrein.

15. The isolated monoclonal antibody of claim 1, wherein the antibody has an apparent inhibition constant ($K_{i,app}$) of plasma kallikrein of less than 100 nM.

16. The isolated monoclonal antibody of claim 15, wherein the antibody has an apparent inhibition constant ($K_{i,app}$) of plasma kallikrein of less than 10 nM.

17. The isolated monoclonal antibody of claim 16, wherein the antibody has an apparent inhibition constant ($K_{i,app}$) of plasma kallikrein of less than 1 nM.

18. The isolated monoclonal antibody of claim 1, wherein the antibody is an IgG or a soluble Fab (sFab).

19. The isolated monoclonal antibody of claim 4, wherein the antibody comprises a heavy chain immunoglobulin variable domain sequence comprising three CDRs from the heavy chain variable domain of an antibody selected from the group consisting of: M162-A04, M160-G12, M142-H08, X63-G06, X101-A01, X81-B01, X67-D03, X67-G04, X115-B07, X115-D05, X115-E09, X115-H06, X115-A03, X115-D01, X115-G04, M29-D09, M145-D11, M06-D09 and M35-G04, and a light chain immunoglobulin variable domain sequence comprising three CDRs from the light chain variable domain of the selected antibody.

20. The isolated monoclonal antibody of claim 19, wherein the antibody comprises three CDRs from the heavy chain variable domain of X81-B01 and three CDRs from the light chain variable domain of X81-B01.

21. The isolated monoclonal antibody of claim 19, wherein the antibody comprises three CDRs from the heavy chain variable domain of X67-D03 and three CDRs from the light chain variable domain of X67-D03.

22. The isolated monoclonal antibody of claim 19, wherein the antibody comprises three CDRs from the heavy chain variable domain of X101-A01 and three CDRs from the light chain variable domain of X101-A01.

23. The isolated monoclonal antibody of claim 19, wherein the antibody comprises three CDRs from the heavy chain variable domain of X63-G06 and three CDRs from the light chain variable domain of X63-G06.

24. The isolated monoclonal antibody of claim 19, wherein the antibody comprises three CDRs from the heavy chain variable domain of M162-A04 and three CDRs from the light chain variable domain of M162-A04.

25. The isolated monoclonal antibody of claim 19, wherein the heavy chain variable domain sequence comprises a heavy chain variable domain sequence of an antibody selected from the group consisting of X81-B01, X63-G06, X101-A01, M162-A04, M160-G12, M142-H08, X67-D03, X67-G04, X115-B07, X115-D05, X115-E09, X115-H06, X115-A03, X115-D01, X115-G04, M29-D09, M145-D11, M06-D09 and M35-G04, and the light chain variable domain sequence comprises a light chain variable domain of the selected antibody.

26. The isolated monoclonal antibody of claim 1, wherein the antibody competes for binding to active plasma kallikrein with epi-Kal2.

27. The isolated monoclonal antibody of claim 1, wherein the antibody competes for binding to active plasma kallikrein with AEBSF.

28. The isolated monoclonal antibody of claim 1, wherein the antibody binds and inhibits plasma kallikrein.

29. A pharmaceutical composition comprising the isolated monoclonal antibody of claim 1 and a pharmaceutically acceptable carrier.

30. The isolated monoclonal antibody of claim 1, wherein the antibody is a full-length antibody or an antigen-binding fragment thereof.

31. The isolated monoclonal antibody of claim 4, wherein the isolated antibody is a full-length antibody or an antigen-binding fragment thereof.

32. The pharmaceutical composition of claim 29, wherein the isolated monoclonal antibody is a full-length antibody or an antigen-binding fragment thereof.

* * * * *

UNITED STATES PATENT AND TRADEMARK OFFICE
CERTIFICATE OF CORRECTION

PATENT NO. : 8,822,653 B2  
APPLICATION NO. : 12/985914  
DATED : September 2, 2014  
INVENTOR(S) : Daniel J. Sexton et al.

Page 1 of 1

It is certified that error appears in the above-identified patent and that said Letters Patent is hereby corrected as shown below:

In the Claims

At Column 251, claim 13, line 63, delete "5478" and insert --S478--

At Column 251, claim 13, line 64, delete "5525" and insert --S525--

Signed and Sealed this  
Second Day of December, 2014

Michelle K. Lee  
*Deputy Director of the United States Patent and Trademark Office*